United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 35

SEQ ID NO: 51240 - protein, 1503 aa, Homo sapiens
MPGPPALRRRLLLLLLVLLIAGSAGAAPLPQTGAGEAPPAAEVSSSFVILCVCSLIILIVLIANCVSCCKDPEIDFKEFEDNFDDEIDFTPPAEDTPSVQSPAEVFTLSVPNISLPAPSQFQPSVEGLKSQVARHSLNYIQEIGNGWFGKVLLGEIYTGTSVARVIVKELKASANPKEQDTFLKNGEPYYILQHPNILQCVGQCVEAIPYLLVFEFCDLGDLKAYLRSEQEHMRGDSQTMLLQRMACEVAAGLAAMHKLHFLHSDLALRNCFLTSDLNVKVGDYGIGFSRYKEDYIETDDKKVFPLRWTAPELVTSFQDRLLTADQTKYSNIWSLGVTLWELFDNAAQPYSNLSNLDVLNQVIRERDTKLPKPQLEQPYSDRWYEVLQFCWLSPEKRPAAEDVHRLLTYLRLQSQRDSEVDFEQQWNALKPNTNSRDSSNNAAFPILDHFARDRLGREMEEVLTVTETSQGLSFEYVWEAAKHDHFDERSRGHLDEGLSYTSIFYPVEVFESSLSDPGPGKQDDSGQDVPLRVPGVVPVFDAHNLSVGSDYYIQLEEKSGSNLELDYPPALLTTDMDNPERTGPELSQLTALRSVELEESSTDEDFFQSSTDPKDSSLPGDLHVTSGPESPFNNIFNDVDKSEDLPSHQKIFDLMELNGVQADFKPATLSSSLDNPKESVITGHFEKEKPRKIFDSEPLCLSDNLMHQDNFDPLNVQELSENFLFLQEKNLLKGSLSSKEHINDLQTELKNAGFTEAMLETSCRNSLDTELQFAENKPGLSLLQENVSTKGDDTDVMLTGDTLSTSLQSSPEVQVPPTSFETEETPRRVPPDSLPTQGETQPTCLDVIVPEDCLHQDISPDAVTVPVEILSTDARTHSLDNRSQDSPGESEETLRLTESDSVLADDILASRVSVGSSLPELGQELHNKPFSEDHHSHRRLEKNLEAVETLNQLNSKDAAKEAGLVSALSSDSTSQDSLLEDSLSAPFPASEPSLETPDSLESVDVHEALLDSLGSHTPQKLVPPDKPADSGYETENLESPEWTLHPAPEGTADSEPATTGDGGHSGLPPNPVIVISDAGDGHRGTEVTPETFTAGSQGSYRDSAYFSDNDSEPEKRSEEVPGTSPSALVLVQEQPLPEPVLPEQSPAAQDSCLEARKSQPDESCLSALHNSSDLELRATPEPAQTGVPQQVHPTEDEASSPWSVLNAELSSGDDFETQDDRPCTLASTGTNTNELLAYTNSALDKSLSSHSEGPKLKEPDIEGKYLGKLGVSGMLDLSEDGMDADEEDENSDDSDEDLRAFNLHSLSSESEDETEHPVPIILSNEDGRHLRSLLKPTAANAPDPLPEDWKKEKKAVTFFDDVTVYLFDQETPTKELGPCGGEACGPDLSGPAPASGSPYLSRCINSESSTDEEGGGFEWDDDFSPDPFMSKTTSNLLSSKPSLQTSKYFSPPPPARSTEQSWPHSAPYSRFSISPANIASFSLTHLTDSDIEQGGSSEDGEKD

SEQ ID NO: 51241 - protein, 61 aa, Homo sapiens
MQPRTQPLAQTLPFFLGGAPRDTGLRVPVIKMGTGWEGFQRTLKEVAYILLCCWCIKELLD

SEQ ID NO: 51242 - protein, 61 aa, Homo sapiens; identical to SEQ ID NO: 51241

SEQ ID NO: 51243 - protein, 173 aa, Homo sapiens
MYSFMGGGLFCAWVGTILLVVAMATDHWMQYRLSGSFAHQGLWRYCLGNKCYLQTDSIAYWNATRAFMILSALCAISGIIMGIMAFAHQPTFSRISRPFSAGIMFFSSTLFVVLALAIYTGVTVSFLGRRFGDWRFSWSYILGWVAVLMTFFAGIFYMCAYRVHECRRLSTPR

SEQ ID NO: 51244 - protein, 215 aa, Homo sapiens
MYSFMGGGLFCAWVGTILLVVAMATDHWMQYRLSGSFAHQGLWRYCLGNKCYLQTDSIGEPPGQGPGRAWGKSRADLGAQGHLYSRWRTLRLKEGKGATQAYWNATRAFMILSALCAISGIIMGIMAFAHQPTFSRISRPFSAGIMFFSSTLFVVLALAIYTGVTVSFLGRRFGDWRFSWSYILGWVAVLMTFFAGIFYMCAYRVHECRRLSTPR

SEQ ID NO: 51245 - protein, 666 aa, Homo sapiens
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDEKQNSDDEEQPQLSDEEKMQNSDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPRPFDPQYYEDEFEDEEMLDEEGRTRLKLKVENTIRWRIRRDEEGNEIKESNARIVKWSDGSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGEPSGKRKAEDDDKANKKHKKYVISDEEEEDDD

SEQ ID NO: 51246 - protein, 606 aa, Homo sapiens
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDEKQNSDDEEQPQLSDEEKMQNSDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGEPSGKRKAEDDDKANKKHKKYVISDEEEEDDD

SEQ ID NO: 51247 - protein, 644 aa, Homo sapiens
MADMEDLFGSDADSEAERKDSDSGSDSDSDQENAASGSNASGSESDQDERGDSGQPSNKELFGDDSEDEGASHHSGSDNHSERSDNRSEASERSDHEDNDPSDVDQHSGSEAPNDDEDEGHRSDGGSHHSEAEGSEKAHSDDEKWGREDKSDQSDDEKIQNSDDEERAQGSDEDKLQNSDDDEKMQNTDDEERPQLSDDERQQLSEEEKANSDDERPVASDNDDDDERPQASDEEHRHSDDEEEQDHKSESARGSDSEDEVLRMKRKNAIASDSEADSDTEVPKDNSGTMDLFGGADDISSGSDGEDKPPTPGQPVDENGLPQDQQEEEPIPETRIEVEIPKVNTDLGNDLYFVKLPNFLSVEPRPFDPQYYEDEFEDEEMLDEEGRTRLKLKVENTIRWRIRRDEEGNEIKESNARIVKWSDGSMSLHLGNEVFDVYKAPLQGDHNHLFIRQGTGLQGQAVFKTKLTFRPHSTDSATHRKMTLSLADRCSKTQKIRILPMAGRDPECQRTEMIKKEEERLRASIRRESQQRRMREKQHQRGLSASYLEPDRYDEEEEGEESISLAAIKNRYKGGIREERARIYSSDSDEGSEEDKAQRLLKAKKLTSDEEGEPSGKRKAEDDDKANKKHKKYVISDEEEEDDD

SEQ ID NO: 51248 - protein, 708 aa, Homo sapiens
MRERIWAPPLLLLLPLLLPPPLWGGPPDSPRRELELEPGPLQPFDLLYASGAAAYYSGDYERAVRDLEAALRSHRRLREIRTRCARHCAARHPLPPPPPGEGPGAELPLFRSLLGRARCYRSCETQRLGGPASRHRVSEDVRSDFQRRVPYNYLQRAYIKLNQLEKAVEAAHTFFVANPEHMEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 51249 - protein, 527 aa, Homo sapiens
MEMQQNIENYRATAGVEALQLVDREAKPHMESYNAGVKHYEADDFEMAIRHFEQALREYFVEDTECRTLCEGPQRFEEYEYLGYKAGLYEAIADHYMQVLVCQHECVRELATRPGRLSPIENFLPLHYDYLQFAYYRVGEYVKALECAKAYLLCHPDDEDVLDNVDYYESLLDDSIDPASIEAREDLTMFVKRHKLESELIKSAAEGLGFSYTEPNYWIRYGGRQDENRVPSGVNVEGAEVHGFSMGKKLSPKIDRDLREGGPLLYENITFVYNSEQLNGTQRVLLDNVLSEEQCRELHSVASGIMLVGDGYRGKTSPHTPNEKFEGATVLKALKSGYEGRVPLKSARLFYDISEKARRIVESYFMLNSTLYFSYTHMVCRTALSGQQDRRNDLSHPIHADNCLLDPEANECWKEPPAYTFRDYSALLYMNDDFEGGEFIFTEMDAKTVTASIKPKCGRMISFSSGGENPHGVKAVTKGKRCAVALWFTLDPLYRELERIQADEVIAILDQEQQGKHELNINPKDEL

SEQ ID NO: 51250 - protein, 906 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKKMPGTKELLGGGWLT

SEQ ID NO: 51251 - protein, 1165 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKPETFEHLFIKHTASVTCGPLLLEPETISEDISVDTSWKNKDEMMPTTVVSLLSTTDLEKGSVCISDQFNSVNFSEAEGTEVTYEDESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 51252 - protein, 906 aa, Homo sapiens; identical to SEQ ID NO: 51250

SEQ ID NO: 51253 - protein, 958 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKMLEGSMFVKSHHHSLISSTQGHKHCGRPQGPLHRKTRDLCSLVYLLTLPPLLSYDPAKSPSVRNTQE

SEQ ID NO: 51254 - protein, 896 aa, Homo sapiens
MICQKFCVVLLHWEFIYVITAFNLSYPITPWRFKLSCMPPNSTYDYFLLPAGLSKNTSNSNGHYETAVEPKFNSSGTHFSNLSKTTFHCCFRSEQDRNCSLCADNIEGKTFVSTVNSLVFQQIDANWNIQCWLKGDLKLFICYVESLFKNLFRNYNYKVHLLYVLPEVLEDSPLVPQKGSFQMVHCNCSVHECCECLVPVPTAKLNDTLLMCLKITSGGVIFQSPLMSVQPINMVKPDPPLGLHMEITDDGNLKISWSSPPLVPFPLQYQVKYSENSTTVIREADKIVSATSLLVDSILPGSSYEVQVRGKRLDGPGIWSDWSTPRVFTTQDVIYFPPKILTSVGSNVSFHCIYKKENKIVPSKEIVWWMNLAEKIPQSQYDVVSDHVSKVTFFNLNETKPRGKFTYDAVYCCNEHECHHRYAELYVIDVNINISCETDGYLTKMTCRWSTSTIQSLAESTLQLRYHRSSLYCSDIPSIHPISEPKDCYLQSDGFYECIFQPIFLLSGYTMWIRINHSLGSLDSPPTCVLPDSVVKPLPPSSVKAEITINIGLLKISWEKPVFPENNLQFQIRYGLSGKEVQWKMYEVYDAKSKSVSLPVPDLCAVYAVQVRCKRLDGLGYWSNWSNPAYTVVMDIKVPMRGPEFWRIINGDTMKKEKNVTLLWKPLMKNDSLCSVQRYVINHHTSCNGTWSEDVGNHTKFTFLWTEQAHTVTVLAINSIGASVANFNLTFSWPMSKVNIVQSLSAYPLNSSCVIVSWILSPSDYKLMYFIIEWKNLNEDGEIKWLRISSSVKKYYIHDHFIPIEKYQFSLYPIFMEGVGKPKIINSFTQDDIEKHQSDAGLYVIVPVIISSSILLLGTLLISHQRMKKLFWEDVPNPKNCSWAQGLNFQKRTDIL

SEQ ID NO: 51255 - protein, 232 aa, Homo sapiens
MMPTTVVSLLSTTDLEKGSVCISDQFNSVNFSEAEGTEVTYEDESQRQPFVKYATLISNSKPSETGEEQGLINSSVTKCFSSKNSPLKDSFSNSSWEIEAQAFFILSDQHPNIISPHLTFSEGLDELLKLEGNFPEENNDKKSIYYLGVTSIKKRESGVLLTDKSRVSCPFPAPCLFTDIRVLQDSCSHFVENNINLGTSSKKTFASYMPQFQTCSTQTHKIMENKMCDLTV

SEQ ID NO: 51256 - protein, 131 aa, Homo sapiens
MAGVKALVALSFSGAIGLTFLMLGCALEDYGVYWPLFVLIFHAISPIPHFIAKRVTYDSDATSSACRELAYFFTTGIVVSAFGFPVILARVAVIKWGACGLVLAGNAVIFLTIQGFFLIFGRGDDFSWEQW

SEQ ID NO: 51257 - protein, 131 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLIEWGACALVLTGNTVIFATILGFFLVFGSNDDFSWQQW

SEQ ID NO: 51258 - protein, 169 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLMGRLPFFSKMGTAESEGRETLTQQLPLPAAAMRRLLPASRVSTQPVLRLADSAESLLGRPALWALGFLLCPPSQAQ

SEQ ID NO: 51259 - protein, 1064 aa, Homo sapiens
MMKFRFRRQGADPQREKLKQELFAFNKTVEHGFPNQPSALAFDPELRIMAIGTRSGAVKIYGAPGVEFTGLHRDAATVTQMHFLTGQGRLLSLLDDSSLHLWEIVHHNGCAHLEEALSFQLPSRPGFDGASAPLSLTRVTVVLLVAASDIAALGTEGSSVFFLDVTTLTLLEGQTLAPGEVLRSVPDDYRCGKALGPVESLQGHLRDPTKILIGYSRGLLVIWNQASQCVDHIFLGNQQLESLCWGRDSSTVVSSHSDGSYAVWSVDAGSFPTLQPTVATTPYGPFPCKAINKILWRNCESGGHFIIFSGGMPRASYGDRHCVSVLRAETLVTLDFTSRIIDFFTVHSTRPEDEFDDPQALAVLLEEELVVLDLQTPGWPAVPAPYLAPLHSSAITCSAHVASVPAKLWARIVSAGEQQSPQPVSSALSWPITGGRNLAQEPSQRGLLLTGHEDGTVRFWDASGVALRPLYKLSTAGLFQTDCEHADSLAQAAEDDWPPFRKVGCFDPYSDDPRLGVQKVALCKYTAQMVVAGTAGQVLVLELSDVPVEQAVSVAIIDLLQDREGFTWKGHERLSPRTGPLPWPAGFQPRVLVQCLPPAAVTAVTLHTEWSLVAFGTSHGFGLFDYQRKSPVLARCTLHPNDSLAMEGPLSRVKSLKKSLRQSFRRIRKSRVSGKKRAANASSKLQEANAQLAEQACPHDVEMTPVQRRIEPRSADDSLSGVVRCLYFADTFLRDGAHHGPTMWAGTNSGSVFAYALEVPAAAVGGEKRPEQAVEAVLGKEVQLMHRAPVVAIAVLDGRGRPLPEPYEASRDLAQAPDMQGGHAVLIASEEQFKVFTLPKVSAKTKFKLTAHEGCRVRKVALATFASVACEDYAETCLACLTNLGDVHVFSVPGLRPQVHYSCIRKEDISGIASCVFTRHGQGFYLISPSEFERFSLSARNITEPLCSLDINWPRDATQASYRIRESPKLSQANGTPSILLAPQSLDGSPDPAHSMGPDTPEPPEAALSPMSIDSATSADTTLDTTGDVTVEDVKDFLGSSEESEKNLRNLAEDEAHACAILIK

SEQ ID NO: 51260 - protein, 351 aa, Homo sapiens
ELPSAAPDSTLLLTAQHWVANLFILATLIGWTVRSFFLGRMETCCSHLGLRSGRRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 51261 - protein, 279 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 51262 - protein, 334 aa, Homo sapiens
MATRQRESSITSCCSTSSCDADDEGVRGTCEDASLCKRFAVSIGYWHDPYIQHFVRLSKERKAPEINRGYFARVHGVSQLIKAFLRKTECHCQIVNLGAGMDTTFWRLKDEDLLPSKYFEVDFPMIVTRKLHSIKCKPPLSSPILELHSEDTLQMDGHILDSKRYAVIGADLRDLSELEEKLKKCNMNTQLPTLLIAECVLVYMTPEQSANLLKWAANSFERAMFINYEQVNMGDRFGQIMIENLRRRQCDLAGVETCKSLESQKERLLSNGWETASAVDMMELYNRLPRAEVSRIESLEFLDEMELLEQLMRHYCLCWATKGGNELGLKEITY

SEQ ID NO: 51263 - protein, 804 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGESSWCCGDPFPERPWFAFLFPKSHCQWLRHERSTWDTSSNALSLWSHCLVLPGPAVNGIQVGKEVKTGSDAEFLVPSLGPTSAVLFQRVGPAGKEMSLGPLRNLPCPLGSSS

SEQ ID NO: 51264 - protein, 736 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 51265 - protein, 697 aa, Homo sapiens
MAVRALKLLTTLLAVVAAASQAEVESEAGWGMVTPDLLFAEGTAAYARGDWPGVVLSMERALRSRAALRALRLRCRTQCAADFPWELDPDWSPSPAQASGAAALRDLSFFGGLLRRAACLRRCLGPPAAHSLSEEMELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERVRAARAGQGAGR

SEQ ID NO: 51266 - protein, 152 aa, Homo sapiens
  MOD_RES (1)..(1): Any amino acid
XERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKRGVVLVRFHTADKDVPETGQFTKERGLLGLTVPCGWG

SEQ ID NO: 51267 - protein, 601 aa, Homo sapiens
MELEFRKRSPYNYLQVAYFKINKLEKAVAAAHTFFVGNPEHMEMQQNLDYYQTMSGVKEADFKDLETQPHMQEFRLGVRLYSEEQPQEAVPHLEAALQEYFVAYEECRALCEGPYDYDGYNYLEYNADLFQAITDHYIQVLNCKQNCVTELASHPSREKPFEDFLPSHYNYLQFAYYNIGNYTQAVECAKTYLLFFPNDEVMNQNLAYYAAMLGEEHTRSIGPRESAKEYRQRSLLEKELLFFAYDVFGIPFVDPDSWTPEEVIPKRLQEKQKSERETAVRISQEIGNLMKEIETLVEEKTKESLDVSRLTREGGPLLYEGISLTMNSKLLNGSQRVVMDGVISDHECQELQRLTNVAATSGDGYRGQTSPHTPNEKFYGVTVFKALKLGQEGKVPLQSAHLYYNVTEKVRRIMESYFRLDTPLYFSYSHLVCRTAIEEVQAERKDDSHPVHVDNCILNAETLVCVKEPPAYTFRDYSAILYLNGDFDGGNFYFTELDAKTVTAEVQPQCGRAVGFSSGTENPHGVKAVTRGQRCAIALWFTLDPRHSERDRVQADDLVKMLFSPEEMDLSQEQPLDAQQGPPEPAQESLSGSESKPKDEL

SEQ ID NO: 51268 - protein, 784 aa, Homo sapiens
MTSPAAAQSREIDCLSPEAQKLAEARLAAKRAARAEAREIRMKELERQQKEEDSERYSRRSRRNTSASDEDERMSVGSRGSLRVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 51269 - protein, 752 aa, Homo sapiens
MTSPAAAQSREIDCLSPEAQKLAEARLAAKRAARAEAREIRMKELERQQKEVEERPEKDFTEKGSRNMPGLSAATLASLGGTSSRRGSGDTSISIDTEASIREIKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 51270 - protein, 630 aa, Homo sapiens
MTSPAAAQSREIDCLSPEAQKLAEARLAAKRAARAEAREIRMKELERQQKEVTSAQEKYYGLDTKWGDIEQWMEDSERYSRRSRRNTSASDEDERMSVGSRGSLRSQPDLEYGGPYAWTNGYDGELYGSQSLNRRSGRPSCLYSAARPSGSYRASVLDEGSFGGTRRGSTSGSRAPSEYSGHLNSSSRASSRASSARASPVVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQRELRSALDKTEELEVSNGHLVKRLEKMKANRSALLSQQ

SEQ ID NO: 51271 - protein, 808 aa, Homo sapiens
MTSPAAAQSREIDCLSPEAQKLAEARLAAKRAARAEAREIRMKELERQQKEEDSERYSRRSRRNTSASDEDERMSVGSRGSLRVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEKHGIILNSEIATNGETSDTLNNVGYQGPTKMTKEELNALKSTGDGTLGRASEVEVKNEIVANVGKREILHNTEKEQHTEDTVKDCVDIEVFPAGENTEDQKSSEDTAPFLGTLAGATYEEQVQSQILESSSLPENTVQVESNEVMGAPDDRTRTPLEPSNCWSDLDGGNHTENVGEAAVTQVEEQAGTVASCPLGHSDDTVYHDDKCMVEVPQELETSTGHSLEKEFTNQEAAEPKEVPAHSTEVGRDHNEEEGEETGLRDEKPIKTEVPGSPAGTEGNCQEATGPSTVDTQNEPLDMKEPDEEKSDQQGEALDSSQKKTKNKKKKNKKKKSPVPVETLKDVKKELTYQNTDLSEIKEEEQVKSTDRKSAVEAQNEVTENPKQKIAAESSENVDCPENPKIKLDGKLDQEGDDVQTAAEEVLADGDTLDFEDDTVQSSGPRAGGEELDEGVAKDNAKIDGATQSSPAEPKSEDADRCTLPEHESPSQDISDACEAESTERCEMSEHPSQTVRKALDSNSLENDDLSAPGREPGHFNPESREDTRGGNEKGKSKEDCTMS

SEQ ID NO: 51272 - protein, 640 aa, Homo sapiens
MDMGTQGSGRKRLPNRERLTAEDDALNQIAREAEARLAAKRAARAEAREIRMKELERQQKEIYQVQKKYYGLDTKWGDIEQWMEDSERYSRRSRRNTSASDEDERMSVGSRGSLRSQPDLEYGGPYAWTNGYDGELYGSQSLNRRSGRPSCLYSAARPSGSYRASVLDEGSFGGTRRGSTSGSRAPSEYSGHLNSSSRASSRASSARASPVVEERPEKDFTEKGSRNMPGLSAATLASLGGTSSRRGSGDTSISIDTEASIREIKELNELKDQIQDVEGKYMQGLKEMKDSLAEVEEKYKKAMVSNAQLDNEKTNFMYQVDTLKDMLLELEEQLAESRRQYEEKNKEFEREKHAHSILQFQFAEVKEALKQREEMLEEIRQLQQKQASSIREISDLQETIEWKDKKIGALERQKEFFDSVRSERDDLREEVVMLKEELKKHGIILNSEIATNGETSDTLNNVGYQGPTKMTKEELNALKSTGDGTLDIRLKKLVDERECLLEQIKKLKGQLEERQKIGKLDNLRSEDDVLENGTDMHVMDLQRDANRQISDLKFKLAKSEQEITALEQNVIRLESQVSRYKSAAENAEKIEDELKAEKRKLQRELRSALDKTEELEVSNGHLVKRLEKMKANRSALLSQQ

SEQ ID NO: 51273 - protein, 721 aa, Homo sapiens
MGTPASGRKRTPVKDRFSAEDEALSNIAREAEARLAAKRAARAEARDIRMRELERQQKEYSLHSFDRKWGQIQKWLEDSERARYSHRSSHHRPYLGVEDALSIRSVGSHRYDMFKDRSSRLSSLNHSYSHSHGMKKRSSDSHKDLLSGLYFDQRNYSSLRHSKPTSAYYTRQSSSLYSDPLATYKSDRASPTANSGLLRSASLASLYNGGLYNPYGPRTPSECSYYSSRISSARSSPGFTNDDTASIVSSDRASRGRRESVVSAADYFSRSNRRGSVVSEVDDISIPDLSSLDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIEEKQRMQQKIDTMTKEVFDLQETLLWKDKKIGALEKQKEYIACLRNERDMLREELADLQETVKTGEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 51274 - protein, 400 aa, Homo sapiens
MGTPASGRKRTPVKDRFSAEDEALSNIAREAEARLAAKRAARAEARDIRMRELERQQKELDEKSDKQYAENYTRPSSRNSASATTPLSGNSSRRGSGDTSSLIDPDTSLSELRESLSEVEEKYKKAMVSNAQLDNEKNNLIYQVDTLKDVIEEQEEQMAEFYRENEEKSKELERQKHMCSVLQHKMEELKEGLRQRDELIEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 51275 - protein, 721 aa, Homo sapiens; identical to SEQ ID NO: 51273

SEQ ID NO: 51276 - protein, 59 aa, Homo sapiens
MGTPASGRKRTPVKDRFSAEDEALSNIAREAEARLAAKRAARAEARDIRMRELERQQKE

SEQ ID NO: 51277 - protein, 59 aa, Homo sapiens; identical to SEQ ID NO: 51276

SEQ ID NO: 51278 - protein, 59 aa, Homo sapiens; identical to SEQ ID NO: 51276

SEQ ID NO: 51279 - protein, 424 aa, Homo sapiens
MGTPASGRKRTPVKDRFSAEDEALSNIAREAEARLAAKRAARAEARDIRMRELERQQKELDEKSDKQYAENYTRPSSRNSASATTPLSGNSSRRGSGDTSSLIDPDTSLSELRDIYDLKDQIQDVEGRYMQGLKELKESLSEVEEKYKKAMVSNAQLDNEKNNLIYQVDTLKDVIEEQEEQMAEFYRENEEKSKELERQKHMCSVLQHKMEELKEGLRQRDELIEKHGLVIIPDGTPNGDVSHEPVAGAITVVSQEAAQVLESAGEGPLDVRLRKLAGEKEELLSQIRKLKLQLEEERQKCSRNDGTVGDLAGLQNGSDLQFIEMQRDANRQISEYKFKLSKAEQDITTLEQSISRLEGQVLRYKTAAENAEKVEDELKAEKRKLQRELRTALDKIEEMEMTNSHLAKRLEKMKANRTALLAQQ

SEQ ID NO: 51280 - protein, 771 aa, Homo sapiens
MAPGPFSSALLSPPPAALPFLLLLWAGASRGQPCPGRCICQNVAPTLTMLCAKTGLLFVPPAIDRRVVELRLTDNFIAAVRRRDFANMTSLVHLTLSRNTIGQVAAGAFADLRALRALHLDSNRLAEVRGDQLRGLGNLRHLILGNNQIRRVESAAFDAFLSTVEDLDLSYNNLEALPWEAVGQMVNLNTLTLDHNLIDHIAEGTFVQLHKLVRLDMTSNRLHKLPPDGLFLRSQGTGPKPPTPLTVSFGGNPLHCNCELLWLRRLTREDDLETCATPEHLTDRYFWSIPEEEFLCEPPLITRQAGGRALVVEGQAVSLRCRAVGDPEPVVHWVAPDGRLLGNSSRTRVRGDGTLDVTITTLRDSGTFTCIASNAAGEATAPVEVCVVPLPLMAPPPAAPPPLTEPGSSDIATPGRPGANDSAAERRLVAAELTSNSVLIRWPAQRPVPGIRMYQVQYNSSVDDSLVYRMIPSTSQTFLVNDLAAGRAYDLCVLAVYDDGATALPATRVVGCVQFTTAGDPAPCRPLRAHFLGGTMIIAIGGVIVASVLVFIVLLMIRYKVYGDGDSRRVKGSRSLPRVSHVCSQTNGAGTGAAQAPALPAQDHYEALREVESQAAPAVAVEAKAMEAETASAEPEVVLGRSLGGSATSLCLLPSEETSGEESRAAVGPRRSRSGALEPPTSAPPTLALVPGGAAARPRPQQRYSFDGDYGALFQSHSYPRRARRTKRHRSTPHLDGAGGGAAGEDGDLGLGSARACLAFTSTEWMLESTV

SEQ ID NO: 51281 - protein, 789 aa, Homo sapiens
METLLGGLLAFGMAFAVVDACPKYCVCQNLSESLGTLCPSKGLLFVPPDIDRRTVELRLGGNFIIHISRQDFANMTGLVDLTLSRNTISHIQPFSFLDLESLRSLHLDSNRLPSLGEDTLRGLVNLQHLIVNNNQLGGIADEAFEDFLLTLEDLDLSYNNLHGLPWDSVRRMVNLHQLSLDHNLLDHIAEGTFADLQKLARLDLTSNRLQKLPPDPIFARSQASALTATPFAPPLSFSFGGNPLHCNCELLWLRRLERDDDLETCGSPGGLKGRYFWHVREEEFVCEPPLITQHTHKLLVLEGQAATLKCKAIGDPSPLIHWVAPDDRLVGNSSRTAVYDNGTLDIFITTSQDSGAFTCIAANAAGEATAMVEVSIVQLPHLSNSTSRTAPPKSRLSDITGSSKTSRGGGGSGGGEPPKSPPERAVLVSEVTTTSALVKWSVSKSAPRVKMYQLQYNCSDDEVLIYRMIPASNKAFVVNNLVSGTGYDLCVLAMWDDTATTLTATNIVGCAQFFTKADYPQCQSMHSQILGGTMILVIGGIIVATLLVFIVILMVRYKVCNHEAPSKMAAAVSNVYSQTNGAQPPPPSSAPAGAPPQGPPKVVVRNELLDFTASLARASDSSSSSSLGSGEAAGLGRAPWRIPPSAPRPKPSLDRLMGAFASLDLKSQRKEELLDSRTPAGRGAGTSARGHHSDREPLLGPPAARARSLLPLPLEGKAKRSHSFDMGDFAAAAAGGVVPGGYSPPRKVSNIWTKRSLSVNGMLLPFEESDLVGARGTFGSSEWVMESTV

SEQ ID NO: 51282 - protein, 628 aa, Homo sapiens
MAILPLLLCLLPLAPASSPPQSATPSPCPRRCRCQTQSLPLSVLCPGAGLLFVPPSLDRRAAELRLADNFIASVRRRDLANMTGLLHLSLSRNTIRHVAAGAFADLRALRALHLDGNRLTSLGEGQLRGLVNLRHLILSNNQLAALAAGALDDCAETLEDLDLSYNNLEQLPWEALGRLGNVNTLGLDHNLLASVPAGAFSRLHKLARLDMTSNRLTTIPPDPLFSRLPLLARPRGSPASALVLAFGGNPLHCNCELVWLRRLAREDDLEACASPPALGGRYFWAVGEEEFVCEPPVVTHRSPPLAVPAGRPAALRCRAVGDPEPRVRWVSPQGRLLGNSSRARAFPNGTLELLVTEPGDGGIFTCIAANAAGEATAAVELTVGPPPPPQLANSTSCDPPRDGDPDALTPPSAASASAKVADTGPPTDRGVQVTEHGATAALVQWPDQRPIPGIRMYQIQYNSSADDILVYRMIPAESRSFLLTDLASGRTYDLCVLAVYEDSATGLTATRPVGCARFSTEPALRPCGAPHAPFLGGTMIIALGGVIVASVLVFIFVLLMRYKVHGGQPPGKAKIPAPVSSVCSQTNGALGPTPTPAPPAPEPAALRAHTVVQLDCEPWGPGHEPVGP

SEQ ID NO: 51283 - protein, 628 aa, Homo sapiens; identical to SEQ ID NO: 51282

SEQ ID NO: 51284 - protein, 635 aa, Homo sapiens
MAPPLLLLLLASGAAACPLPCVCQNLSESLSTLCAHRGLLFVPPNVDRRTVELRLADNFIQALGPPDFRNMTGLVDLTLSRNAITRIGARAFGDLESLRSLHLDGNRLVELGTGSLRGPVNLQHLILSGNQLGRIAPGAFDDFLESLEDLDLSYNNLRQVPWAGIGAMPALHTLNLDHNLIDALPPGAFAQLGQLSRLDLTSNRLATLAPDPLFSRGRDAEASPAPLVLSFSGNPLHCNCELLWLRRLARPDDLETCASPPGLAGRYFWAVPEGEFSCEPPLIARHTQRLWVLEGQRATLRCRALGDPAPTMHWVGPDDRLVGNSSRARAFPNGTLEIGVTGAGDAGGYTCIATNPAGEATARVELRVLALPHGGNSSAEGGRPGPSDIAASARTAAEGEGTLESEPAVQVTEVTATSGLVSWGPGRPADPVWMFQIQYNSSEDETLIYRIVPASSHHFLLKHLVPGADYDLCLLALSPAAGPSDLTATRLLGCAHFSTLPASPLCHALQAHVLGGTLTVAVGGVLVAALLVFTVALLVRGRGAGNGRLPLKLSHVQSQTNGGPSPTPKAHPPRSPPPRPQRSCSLDLGDAGCYGYARRLGGAWARRSHSVHGGLLGAGCRGVGGSAERLEESVV

SEQ ID NO: 51285 - protein, 719 aa, Homo sapiens
MEKILFYLFLIGIAVKAQICPKRCVCQILSPNLATLCAKKGLLFVPPNIDRRTVELRLADNFVTNIKRKDFANMTSLVDLTLSRNTISFITPHAFADLRNLRALHLNSNRLTKITNDMFSGLSNLHHLILNNNQLTLISSTAFDDVFALEELDLSYNNLETIPWDAVEKMVSLHTLSLDHNMIDNIPKGTFSHLHKMTRLDVTSNKLQKLPPDPLFQRAQVLATSGIISPSTFALSFGGNPLHCNCELLWLRRLSREDDLETCASPPLLTGRYFWSIPEEEFLCEPPLITRHTHEMRVLEGQRATLRCKARGDPEPAIHWISPEGKLISNATRSLVYDNGTLDILITTVKDTGAFTCIASNPAGEATQIVDLHIIKLPHLLNSTNHIHEPDPGSSDISTSTKSGSNTSSSNGDTKLSQDKIVVAEATSSTALLKFNFQRNIPGIRMFQIQYNGTYDDTLVYRMIPPTSKTFLVNNLAAGTMYDLCVLAIYDDGITSLTATRVVGCIQFTTEQDYVRCHFMQSQFLGGTMIIIIGGIIVASVLVFIIILMIRYKVCNNNGQHKVTKVSNVYSQTNGAQIQGCSVTLPQSVSKQAVGHEENAQCCKATSDNVIQSSETCSSQDSSTTTSALPPSWTSSTSVSQKQKRKTGTKPSTEPQNEAVTNVESQNTNRNNSTALQLASRPPDSVTEGPTSKRAHIKPNALLTNVDQIVQETQRLELI

SEQ ID NO: 51286 - protein, 620 aa, Homo sapiens
MQVSKRMLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 51287 - protein, 55 aa, Homo sapiens
MLAGGVRSMPSPLLACWQPILLLVLGSVLSGSATGCPPRCECSAQDRAVLCHRKR

SEQ ID NO: 51288 - protein, 614 aa, Homo sapiens
MLAGGVRSMPSPLLACWQPILLLVLGSVLSGSATGCPPRCECSAQDRAVLCHRKRFVAVPEGIPTETRLLDLGKNRIKTLNQDEFASFPHLEELELNENIVSAVEPGAFNNLFNLRTLGLRSNRLKLIPLGVFTGLSNLTKLDISENKIVILLDYMFQDLYNLKSLEVGDNDLVYISHRAFSGLNSLEQLTLEKCNLTSIPTEALSHLHGLIVLRLRHLNINAIRDYSFKRLYRLKVLEISHWPYLDTMTPNCLYGLNLTSLSITHCNLTAVPYLAVRHLVYLRFLNLSYNPISTIEGSMLHELLRLQEIQLVGGQLAVVEPYAFRGLNYLRVLNVSGNQLTTLEESVFHSVGNLETLILDSNPLACDCRLLWVFRRRWRLNFNRQQPTCATPEFVQGKEFKDFPDVLLPNYFTCRRARIRDRKAQQVFVDEGHTVQFVCRADGDPPPAILWLSPRKHLVSAKSNGRLTVFPDGTLEVRYAQVQDNGTYLCIAANAGGNDSMPAHLHVRSYSPDWPHQPNKTFAFISNQPGEGEANSTRATVPFPFDIKTLIIATTMGFISFLGVVLFCLVLLFLWSRGKGNTKHNIEIEYVPRKSDAGISSADAPRKFNMKMI

SEQ ID NO: 51289 - protein, 606 aa, Homo sapiens
MLHTAISCWQPFLGLAVVLIFMGSTIGCPARCECSAQNKSVSCHRRRLIAIPEGIPIETKILDLSKNRLKSVNPEEFISYPLLEEIDLSDNIIANVEPGAFNNLFNLRSLRLKGNRLKLVPLGVFTGLSNLTKLDISENKIVILLDYMFQDLHNLKSLEVGDNDLVYISHRAFSGLLSLEQLTLEKCNLTAVPTEALSHLRSLISLHLKHLNINNMPVYAFKRLFHLKHLEIDYWPLLDMMPANSLYGLNLTSLSVTNTNLSTVPFLAFKHLVYLTHLNLSYNPISTIEAGMFSDLIRLQELHIVGAQLRTIEPHSFQGLRFLRVLNVSQNLLETLEENVFSSPRALEVLSINNNPLACDCRLLWILQRQPTLQFGGQQPMCAGPDTIRERSFKDFHSTALSFYFTCKKPKIREKKLQHLLVDEGQTVQLECSADGDPQPVISWVTPRRRFITTKSNGRATVLGDGTLEIRFAQDQDSGMYVCIASNAAGNDTFTASLTVKGFASDRFLYANRTPMYMTDSNDTISNGTNANTFSLDLKTILVSTAMGCFTFLGVVLFCFLLLFVWSRGKGKHKNSIDLEYVPRKNNGAVVEGEVAGPRRFNMKMI

SEQ ID NO: 51290 - protein, 606 aa, Homo sapiens; identical to SEQ ID NO: 51289

SEQ ID NO: 51291 - protein, 592 aa, Homo sapiens
MTCWLCVLSLPLLLLPAAPPPAGGCPARCECTVQTRAVACTRRRLTAVPDGIPAETRLLELSRNRIRCLNPGDLAALPALEELDLSENAIAHVEPGAFANLPRLRVLRLRGNQLKLIPPGVFTRLDNLTLLDLSENKLVILLDYTFQDLHSLRRLEVGDNDLVFVSRRAFAGLLALEELTLERCNLTALSGESLGHLRSLGALRLRHLAIASLEDQNFRRLPGLLHLEIDNWPLLEEVAAGSLRGLNLTSLSVTHTNITAVPAAALRHQAHLTCLNLSHNPISTVPRGSFRDLVRLRELHLAGALLAVVEPQAFLGLRQIRLLNLSNNLLSTLEESTFHSVNTLETLRVDGNPLACDCRLLWIVQRRKTLNFDGRLPACATPAEVRGDALRNLPDSVLFEYFVCRKPKIRERRLQRVTATAGEDVRFLCRAEGEPAPTVAWVTPQHRPVTATSAGRARVLPGGTLEIQDARPQDSGTYTCVASNAGGNDTYFATLTVRPEPAANRTPGEAHNETLAALRAPLDLTTILVSTAMGCITFLGVVLFCFVLLFVWSRGRGQHKNNFSVEYSFRKVDGPAAAAGQGGARKFNMKMI

SEQ ID NO: 51292 - protein, 723 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLNAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQIKLIETELLQLTQLELKRKSLDTESLQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 51293 - protein, 723 aa, Homo sapiens; identical to SEQ ID NO: 51292

SEQ ID NO: 51294 - protein, 723 aa, Homo sapiens; identical to SEQ ID NO: 51292

SEQ ID NO: 51295 - protein, 696 aa, Homo sapiens
MPLFFRKRKPSEEARKRLEYQMCLAKEAGADDILDISKCELSEIPFGAFATCKVLQKKVLIVHTNHLTSLLPKSCSLLSLATIKVLDLHDNQLTALPDDLGQLTALQVLNVERNQLMQLPRSIGNLTQLQTLNVKDNKLKELPDTVGELRSLRTLNISGNEIQRLPQMLAHVRTLEMLSLDASAMVYPPREVCGAGTAAILQFLCKESGLEYYPPSQYLLPILEQDGIENSRDSPDGPTDRFSREELEWQNRFSDYEKRKEQKMLEKLEFERRLELGQREHTQLLQQSSSQKDEILQTVKEEQSRLEQGLSEHQRHLNAERQRLQEQLKQTEQNISSRIQKLLQDNQRQKKSSEILKSLENERIRMEQLMSITQEETESLRRRDVASAMQQMLTESCKNRLIQMAYESQRQNLVQQACSSMAEMDERFQQILSWQQMDQNKAISQILQESAMQKAAFEALQVKKDLMHRQIRSQEMISEQRWALSSLLQQLLKEKQQREEELREILTELEAKSETRQENYWLIQYQRLLNQKPLSLKLQEEGMERQLVALLEELSAEHYLPIFAHHRLSLDLLSQMSPGDLAKVGVSEAGLQHEILRRVQELLDAARIQPELKPPMGEVVTPTAPQEPPESVRPSAPPAELEVQASECVVCLEREAQMIFLNCGHVCCCQQCCQPLRTCPLCRQDIAQRLRIYHSS

SEQ ID NO: 51296 - protein, 154 aa, Homo sapiens
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGKQKTTS

SEQ ID NO: 51297 - protein, 524 aa, Homo sapiens
MFHCIPLWRCNRHVESIDKRHCSLVYVPEEIYRYARSLEELLLDANQLRELPEQFFQLVKLRKLGLSDNEIQRLPPEIANFMQLVELDVSRNEIPEIPESISFCKALQVADFSGNPLTRLPESFPELQNLTCLSVNDISLQSLPENIGNLYNLASLELRENLLTYLPDSLTQLRRLEELDLGNNEIYNLPESIGALLHLKDLWLDGNQLSELPQEIGNLKNLLCLDVSENRLERLPEEISGLTSLTDLVISQNLLETIPDGIGKLKKLSILKVDQNRLTQLPEAVGECESLTELVLTENQLLTLPKSIGKLKKLSNLNADRNKLVSLPKEIGGCCSLTVFCVRDNRLTRIPAEVSQATELHVLDVAGNRLLHLPLSLTALKLKALWLSDNQSQPLLTFQTDTDYTTGEKILTCVLLPQLPSEPTCQENLPRCGALENLVNDVSDEAWNERAVNRVSAIRFVEDEKDEEDNETRTLLRRATPHPGELKHMKKTVENLRNDMNAAKGLDSNKNEVNHAIDRVTTSV

SEQ ID NO: 51298 - protein, 277 aa, Homo sapiens
MGNTIRALVAFIPADRCQNYVVRDLREMPLDKMVDLSGSQLRRFPLHVCSFRELVKLYLSDNHLNSLPPELGQLQNLQILALDFNNFKALPQVVCTLKQLCILYLGNNKLCDLPSELSLLQNLRTLWIEANCLTQLPDVVCELSLLKTLHAGSNALRLLPGQLRRLQELRTIWLSGNRLTDFPTVLLHMPFLEVIDVDWNSIRYFPSLAHLSSLKLVIYDHNPCRNAPKVAKGVRRVGRWAEETPEPDPRKARRYALVREESQELQAPVPLLPPTNS

SEQ ID NO: 51299 - protein, 1371 aa, Homo sapiens
MTEESSDVPRELIESIKDVIGRKIKISVKKKVKLEVKGDKVENKVLVLTSCRAFLVTARIPTKLELTFSYLEIHGVVCSKSAQMIVETEKCSISMKMASPEDVSEVLAHIGTCLRKIFPGLSPVRIMKKVSMEPSERLASLQALWDSQTVAEQGPCGGFSQMYACVCDWLGFSYREEVQWDVDTIYLTQDTRELNLQDFSHLDHRDLIPIIAALEYNQWFTKLSSKDLKLSTDVCEQILRVVSRSNRLEELVLENAGLRTDFAQKLASALAHNPNSGLHTINLAGNPLEDRGVSSLSIQFAKLPKGLKHLNLSKTSLSPKGVNSLSQSLSANPLTASTLVHLDLSGNVLRGDDLSHMYNFLAQPNAIVHLDLSNTECSLDMVCGALLRGCLQYLAVLNLSRTVFSHRKGKEVPPSFKQFFSSSLALMHINLSGTKLSPEPLKALLLGLACNHNLKGVSLDLSNCELRSGGAQVLEGCIAEIHNITSLDISDNGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQEKRAACAQKKLGNDAVSQDSSSPALSGVERSDGGGAVPKLHPGLPENRFGLGTPEKNTKAEPKAEAGSRSRSSSSTPTSPKPLLQSPKPSLAARPVIPQKPRTASRPDDIPDSPSSPKVALLPPVLKKVPSDKERDGQSSPQPSPRTFSQEVSRRSWGQQAQEYQEQKQRSSSKDGHQGSKSNDSGEEAEKEFIFV

SEQ ID NO: 51300 - protein, 176 aa, Homo sapiens
MYACVCDWLGFSYREEVQWDVDTIYLTQDTRELNLQDFSHLDHRDLIPIIAALEYNQWFTKLSSKDLKLSTDVCEQILRVVSRSNRLEELVLENAGLRTDFAQKLASALAHNPNSGLHTINLAGNPLEDRETTTKIKRQNVPTVLQTYLVVCPSDYQPCPLPLGKDNYYSDFSHDG

SEQ ID NO: 51301 - protein, 1326 aa, Homo sapiens
MTEESSDVPRELIESIKDVIGRKIKISVKKKVKLEVKGDKVENKVLVLTSCRAFLVTARIPTKLELTFSYLEIHGVVCSKSAQMIVETEKCSISMKMASPEDVSEVLAHIGTCLRKIFPGLSPVRIMKKVSMEPSERLASLQALWDSQTVAEQGPCGGFSQMYACVCDWLGFSYREEVQWDVDTIYLTQDTRELNLQDFSHLDHRDLIPIIAALEYNQWFTKLSSKDLKLSTDVCEQILRVVSRSNRLEELVLENAGLRTDFAQKLASALAHNPNSGLHTINLAGNPLEDRGVSSLSIQFAKLPKGLKHLNLSKTSLSPKGVNSLSQSLSANPLTASTLVHLDLSGNVLRGDDLSHMYNFLAQPNAIVHLDLSNTECSLDMVCGALLRGCLQYLAVLNLSRTVFSHRKGKEVPPSFKQFFSSSLALMHINLSGTKLSPEPLKALLLGLACNHNLKGVSLDLSNCELRSGGAQVLEGCIAEIHNITSLDISDNGLESDLSTLIVWLSKNRSIQHLALGKNFNNMKSKNLTPVLDNLVQMIQDEESPLQSLSLADSKLKTEVTIIINALGSNTSLTKVDISGNGMGDMGAKMLAKALQINTKLRTVIWDKNNITAQGFQDIAVAMEKNYTLRFMPIPMYDASQALKTNPEKTEDALQKIENYLLRNHETRKYLQEQAYRLQQGIVTSTTQQMIDRICVKVQDHLNSLRNCGGDAIQEDLKSAERLMRDAKNSKTLLPNLYHVGGASWAGASGLLSSPIQETLESMAGEVTRVVDEQLKALLESMVDAAENLCPNVMKKAHIRQDLIHASTEKISIPRTFVKNVLLEQSGIDILNKISEVKLTVASFLSDRIVDEILDALSHCHHKLADHFSRRGKTLPQQESLEIELAEEKPVKRSIITVEELTEIERLEDLDTCMMTPKSKRKSIHSRMLRPVSRAFEMEFDLDKALEEVPIHIEDPPFPSLRQEKRSSGFISELPSEEGKKLEHFTKLRPKRNKKQQPTQAAVCAANIVSQDGEQNGLMGRVDEGVDEFFTKKVTKMDSKKWSTRGSESHELNEGGDEKKKRDSRKSSGFLNLIKSRSKSERPPTILMTEEPSSPKGAVRSPPVDCPRKDTKAAEHNGNSERIEEIKTPDSFEESQGEEIGKVERSDSKSSPQAGRRYGVQVMGSGLLAEMKAKQENRFGLGTPEKNTKAEPKAEAGSRSRSSSSTPTSPKPLLQSPKPSLAARPVIPQKPRTASRPDDIPDSPSSPKVALLPPVLKKVPSDKERDGQSSPQPSPRTFSQEVSRRSWGQQAQEYQEQKQRSSSKDGHQGSKSNDSGEEAEKEFIFV

SEQ ID NO: 51302 - protein, 371 aa, Homo sapiens
MGHKVVVFDISVIRALWETRVKKHKAWQKKEVERLEKSALEKIKEEWNFVAECRRKGIPQAVYCKNGFIDTSVRLLDKIERNTLTRQSSLPKDRGKRSSAFVFELSGEHWTELPDSLKEQTHLREWYISNTLIQIIPTYIQLFQAMRILDLPKNQISHLPAEIGCLKNLKELNVGFNYLKSIPPELGDCENLERLDCSGNLELMELPFELSNLKQVTFVDISANKFSSVPICVLRMSNLQWLDISSNNLTDLPQDIDRLEELQSFLLYKNKLTYLPYSMLNLKKLTLLVVSGDHLVELPTALCDSSTPLKFVSLMDNPIDNAQCEDGNEIMESERDRQHFDKEVMKAYIEDLKERESVPSYTTKVSFSLQL

SEQ ID NO: 51303 - protein, 371 aa, Homo sapiens; identical to SEQ ID NO: 51302

SEQ ID NO: 51304 - protein, 305 aa, Homo sapiens
MGGTLAWTLLLPLLLRESDSLEPSCTVSSADVDWNAEFSATCLNFSGLSLSLPHNQSLRASNVILLDLSGNGLRELPVTFFAHLQKLEVLNVLRNPLSRVDGALAARCDLDLQADCNCALESWHDIRRDNCSGQKPLLCWDTTSSQHNLSAFLEVSCAPGLASATIGAVVVSGCLLLGLAIAGPVLAWRLWRCRVARSRELNKPWAAQDGPKPGLGLQPRYGSRSAPKPQVAVPSCPSTPDYENMFVGQPAAEHQWDEQGAHPSEDNDFYINYKDIDLASQPVYCNLQSLGQAPMDEEEYVIPGH

SEQ ID NO: 51305 - protein, 334 aa, Homo sapiens
MRGPSWSRPRPLLLLLLLLSPWPVWAQVSATASPSGSLGAPDCPEVCTCVPGGLASCSALSLPAVPPGLSLRLRALLLDHNRVRALPPGAFAGAGALQRLDLRENGLHSVHVRAFWGLGALQLLDLSANQLEALAPGTFAPLRALRNLSLAGNRLARLEPAALGALPLLRSLSLQDNELAALAPGLLGRLPALDALHLRGNPWGCGCALRPLCAWLRRHPLPASEAETVLCVWPGRLTLSPLTAFSDAAFSHCAQPLALRDLAVVYTLGPASFLVSLASCLALGSGLTACRARRRRLRTAALRPPRPPDPNPDPDPHGCASPADPGSPAAAAQA

SEQ ID NO: 51306 - protein, 640 aa, Homo sapiens
MLNKMTLHPQQIMIGPRFNRALFDPLLVVLLALQLLVVAGLVRAQTCPSVCSCSNQFSKVICVRKNLREVPDGISTNTRLLNLHENQIQIIKVNSFKHLRHLEILQLSRNHIRTIEIGAFNGLANLNTLELFDNRLTTIPNGAFVYLSKLKELWLRNNPIESIPSYAFNRIPSLRRLDLGELKRLSYISEGAFEGLSNLRYLNLAMCNLREIPNLTPLIKLDELDLSGNHLSAIRPGSFQGLMHLQKLWMIQSQIQVIERNAFDNLQSLVEINLAHNNLTLLPHDLFTPLHHLERIHLHHNPWNCNCDILWLSWWIKDMAPSNTACCARCNTPPNLKGRYIGELDQNYFTCYAPVIVEPPADLNVTEGMAAELKCRASTSLTSVSWITPNGTVMTHGAYKVRIAVLSDGTLNFTNVTVQDTGMYTCMVSNSVGNTTASATLNVTAATTTPFSYFSTVTVETMEPSQDEARTTDNNVGPTPVVDWETTNVTTSLTPQSTRSTEKTFTIPVTDINSGIPGIDEVMKTTKIIIGCFVAITLMAAVMLVIFYKMRKQHHRQNHHAPTRTVEIINVDDEITGDTPMESHLPMPAIEHEHLNHYNSYKSPFNHTTTVNTINSIHSSVHEPLLIRMNSKDNVQETQI

SEQ ID NO: 51307 - protein, 640 aa, Homo sapiens; identical to SEQ ID NO: 51306

SEQ ID NO: 51308 - protein, 640 aa, Homo sapiens; identical to SEQ ID NO: 51306

SEQ ID NO: 51309 - protein, 640 aa, Homo sapiens; identical to SEQ ID NO: 51306

SEQ ID NO: 51310 - protein, 41 aa, Homo sapiens
MLNKMTLHPQQIMIGPRFNRALFDPLLVVLLALQLLVVAGL

SEQ ID NO: 51311 - protein, 1537 aa, Homo sapiens
MTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRNAAYKHNTVNLGMLPYGGISAMHAGRSMTLNLQTKSKFDHQELPLQKTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 51312 - protein, 1495 aa, Homo sapiens
MQCLEMTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 51313 - protein, 179 aa, Homo sapiens
MTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPKI

SEQ ID NO: 51314 - protein, 1313 aa, Homo sapiens
RSMHKLAQLERLDLGNNEFGELPEVLDQIQNLRELWMDNNALQVLPGSIGKLKMLVYLDMSKNRIETVDMDISGCEALEDLLLSSNMLQQLPDSIGLLKKLTTLKVDDNQLTMLPNTIGNLSLLEEFDCSCNELESLPSTIGYLHSLRTLAVDENFLPELPREIGSCKNVTVMSLRSNKLEFLPEEIGQMQKLRVLNLSDNRLKNLPFSFTKLKELAALWLSDNQSKALIPLQTEAHPETKQRVLTNYMFPQQPRGDEDFQSDSDSFNPTLWEEQRQQRMTVAFEFEDKKEDDENAGKVKDLSCQAPWERGQRGITLQPARLSGDCCTPWARCDQQIQDMPVPQNDPQLAWGCISGLQQERSMCTPLPVAAQSTTLPSLSGRQVEINLKRYPTPYPEDLKNMVKSVQNLVGKPSHGVRVENSNPTANTEQTVKEKYEHKWPVAPKEITVEDSFVHPANEMRIGELHPSLAETPLYPPKLVLLGKDKKESTDESEVDKTHCLNNSVSSGTYSDYSPSQASSGSSNTRVKVGSLQTTAKDAVHNSLWGNRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 51315 - protein, 217 aa, Homo sapiens
MMENLIRGRNPPQYQRSPCKEVRAALRKRPEEELQCLEMTTKRKIIGRLVPCRCFRGEEEIISVLDYSHCSLQQVPKEVFNFERTLEELYLDANQIEELPKQLFNCQALRKLSIPDNDLSNLPTTIASLVNLKELDISKNGVQEFPENIKCCKCLTIIEASVNPISKLPDGFTQLLNLTQLYLNDAFLEFLPANFGRLVKLRILELRENHLKTLPNI

SEQ ID NO: 51316 - protein, 821 aa, Homo sapiens
MTKMLGKLRIAPSFPQPLDSKPLLSQREAVPPGNIPQRPDRLPMSDTFTDNWTDGSHYDNTGFVAEETTAENANSNPLLSSKSRSTSSHGRRPLIRQDRIVGVPLELEQSTHRHTPETEVPPSNPWQNWTRTPSPFEDRTAFPSKLETTPTTSPLPERKEHIKESTEIPSPFSPGVPWEYHDSNPNRSLSNVFSQIHCRPESSKGVISISKSTERLSPLMKDIKSNKFKKSQSIDEIDIGTYKVYNIPLENYASGSDHLGSHERPDKMLGPEHGMSSMSRSQSVPMLDDEMLTYGSSKGPQQQKASMTKKVYQFDQSFNPQGSVEVKAEKRIPPPFQHNPEYVQQASKNIAKDLISPRAYRGYPPMEQMFSFSQPSVNEDAVVNAQFASQGARAGFLRRADSLVSATEMAMFRRVNEPHELPPTDRYGRPPYRGGLDRQSSVTVTESQFLKRNGRYEDEHPSYQEVKAQAGSFPVKNLTQRRPLSARSYSTESYGASQTRPVSARPTMAALLEKIPSDYNLGNYGDKPSDNSDLKTRPTPVKGEESCGKMPADWRQQLLRHIEARRLDRNAAYKHNTVNLGMLPYGGISAMHAGRSMTLNLQTKSKFDHQELPLQKTPSQQSNILDNGQEDVSPSGQWNPYPLGRRDVPPDTITKKAGSHIQTLMGSQSLQHRSREQQPYEGNINKVTIQQFQSPLPIQIPSSQATRGPQPGRCLIQTKGQRSMDGYPEQFCVRIEKNPGLGFSISGGISGQGNPFKPSDKGIFVTRVQPDGPASNLLQPGDKILQANGHSFVHMEHEKAVLLLKSFQNTVDLVIQRELTV

SEQ ID NO: 51317 - protein, 810 aa, Homo sapiens
MIPVTELRYFADTQPAYRILKPWWDVFTDYISIVMLMIAVFGGTLQVTQDKMICLPCKWVTKDSCNDSFRGWAAPGPEPTYPNSTILPTPDTGPTGIKYDLDRHQYNYVDAVCYENRLHWFAKYFPYLVLLHTLIFLACSNFWFKFPRTSSKLEHFVSILLKCFDSPWTTRALSETVVEESDPKPAFSKMNGSMDKKSSTVSEDVEATVPMLQRTKSRIEQGIVDRSETGVLDKKEGEQAKALFEKVKKFRTHVEEGDIVYRLYMRQTIIKVIKFILIICYTVYYVHNIKFDVDCTVDIESLTGYRTYRCAHPLATLFKILASFYISLVIFYGLICMYTLWWMLRRSLKKYSFESIREESSYSDIPDVKNDFAFMLHLIDQYDPLYSKRFAVFLSEVSENKLRQLNLNNEWTLDKLRQRLTKNAQDKLELHLFMLSGIPDTVFDLVELEVLKLELIPDVTIPPSIAQLTGLKELWLYHTAAKIEAPALAFLRENLRALHIKFTDIKEIPLWIYSLKTLEELHLTGNLSAENNRYIVIDGLRELKRLKVLRLKSNLSKLPQVVTDVGVHLQKLSINNEGTKLIVLNSLKKMANLTELELIRCDLERIPHSIFSLHNLQEIDLKDNNLKTIEEIISFQHLHRLTCLKLWYNHIAYIPIQIGNLTNLERLYLNRNKIEKIPTQLFYCRKLRYLDLSHNNLTFLPADIGLLQNLQNLAITANRIETLPPELFQCRKLRALHLGNNVLQSLPSRVGELTNLTQIELRGNRLECLPVELGECPLLKRSGLVVEEDLFNTLPPEVKERLWRADKEQA

SEQ ID NO: 51318 - protein, 810 aa, Homo sapiens; identical to SEQ ID NO: 51317

SEQ ID NO: 51319 - protein, 810 aa, Homo sapiens; identical to SEQ ID NO: 51317

SEQ ID NO: 51320 - protein, 803 aa, Homo sapiens
MITLTELKCLADAQSSYHILKPWWDVFWYYITLIMLLVAVLAGALQLTQSRVLCCLPCKVEFDNHCAVPWDILKASMNTSSNPGTPLPLPLRIQNDLHRQQYSYIDAVCYEKQLHWFAKFFPYLVLLHTLIFAACSNFWLHYPSTSSRLEHFVAILHKCFDSPWTTRALSETVAEQSVRPLKLSKSKILLSSSGCSADIDSGKQSLPYPQPGLESAGIESPTSSVLDKKEGEQAKAIFEKVKRFRMHVEQKDIIYRVYLKQIIVKVILFVLIITYVPYFLTHITLEIDCSVDVQAFTGYKRYQCVYSLAEIFKVLASFYVILVILYGLTSSYSLWWMLRSSLKQYSFEALREKSNYSDIPDVKNDFAFILHLADQYDPLYSKRFSIFLSEVSENKLKQINLNNEWTVEKLKSKLVKNAQDKIELHLFMLNGLPDNVFELTEMEVLSLELIPEVKLPSAVSQLVNLKELRVYHSSLVVDHPALAFLEENLKILRLKFTEMGKIPRWVFHLKNLKELYLSGCVLPEQLSTMQLEGFQDLKNLRTLYLKSSLSRIPQVVTDLLPSLQKLSLDNEGSKLVVLNNLKKMVNLKSLELISCDLERIPHSIFSLNNLHELDLRENNLKTVEEIISFQHLQNLSCLKLWHNNIAYIPAQIGALSNLEQLSLDHNNIENLPLQLFLCTKLHYLDLSYNHLTFIPEEIQYLSNLQYFAVTNNNIEMLPDGLFQCKKLQCLLLGKNSLMNLSPHVGELSNLTHLELIGNYLETLPPELEGCQSLKRNCLIVEENLLNTLPLPVTERLQTCLDKC

SEQ ID NO: 51321 - protein, 803 aa, Homo sapiens; identical to SEQ ID NO: 51320

SEQ ID NO: 51322 - protein, 803 aa, Homo sapiens; identical to SEQ ID NO: 51320

SEQ ID NO: 51323 - protein, 103 aa, Homo sapiens
MITLTELKCLADAQSSYHILKPWWDVFWYYITLIMLLVAVLAGALQLTQSRVLCCLPCKVEFDNHCAVPWDILKASMNTSSNPGTPLPLPLRIQNDLHRQQYS

SEQ ID NO: 51324 - protein, 230 aa, Homo sapiens [sequence omitted]

SEQ ID NO: 51325 - protein, 803 aa, Homo sapiens
MIPVTEFRQFSEQQPAFRVLKPWWDVFTDYLSVAMLMIGVFGCTLQVMQDKIICLPKRVQPAQNHSSLSNVSQAVASTTPLPPPKPSPANPITVEMKGLKTDLDLQQYSFINQMCYERALHWYAKYFPYLVLIHTLVFMLCSNFWFKFPGSSSKIEHFISILGKCFDSPWTTRALSEVSGEDSEEKDNRKNNMNRSNTIQSGPEDSLVNSQSLKSIPEKFVVDKSTAGALDKKEGEQAKALFEKVKKFRLHVEEGDILYAMYVRQTVLKVIKFLIIIAYNSALVSKVQFTVDCNVDIQDMTGYKNFSCNHTMAHLFSKLSFCYLCFVSIYGLTCLYTLYWLFYRSLREYSFEYVRQETGIDDIPDVKNDFAFMLHMIDQYDPLYSKRFAVFLSEVSENKLKQLNLNNEWTPDKLRQKLQTNAHNRLELPLIMLSGLPDTVFEITELQSLKLEIIKNVMIPATIAQLDNLQELSLHQCSVKIHSAALSFLKENLKVLSVKFDDMRELPPWMYGLRNLEELYLVGSLSHDISRNVTLESLRDLKSLKILSIKSNVSKIPQAVVDVSSHLQKMCIHNDGTKLVMLNNLKKMTNLTELELVHCDLERIPHAVFSLLSLQELDLKENNLKSIEEIVSFQHLRKLTVLKLWHNSITYIPEHIKKLTSLERLSFSHNKIEVLPSHLFLCNKIRYLDLSYNDIRFIPPEIGVLQSLQYFSITCNKVESLPDELYFCKKLKTLKIGKNSLSVLSPKIGNLLFLSYLDVKGNHFEILPPELGDCRALKRAGLVVEDALFETLPSDVREQMKTE

SEQ ID NO: 51326 - protein, 858 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMTILDKKDGEQAKALFEKVRKFRAHVEDSDLIYKLYVVQTVIKTAKFIFILCYTANFVNAISFEHVCKPKVEHLIGYEVFECTHNMAYMLKKLLISYISIICVYGFICLYTLFWLFRIPLKEYSFEKVREESSFSDIPDVKNDFAFLLHMVDQYDQLYSKRFGVFLSEVSENKLREISLNHEWTFEKLRQHISRNAQDKQELHLFMLSGVPDAVFDLTDLDVLKLELIPEAKIPAKISQMTNLQELHLCHCPAKVEQTAFSFLRDHLRCLHVKFTDVAEIPAWVYLLKNLRELYLIGNLNSENNKMIGLESLRELRHLKILHVKSNLTKVPSNITDVAPHLTKLVIHNDGTKLLVLNSLKKMMNVAELELQNCELERIPHAIFSLSNLQELDLKSNNIRTIEEIISFQHLKRLTCLKLWHNKIVTIPPSITHVKNLESLYFSNNKLESLPVAVFSLQKLRCLDVSYNNISMIPIEIGLLQNLQHLHITGNKVDILPKQLFKCIKLRTLNLGQNCITSLPEKVGQLSQLTQLELKGNCLDRLPAQLGQCRMLKKSGLVVEDHLFDTLPLEVKEALNQDINIPFANGI

SEQ ID NO: 51327 - protein, 858 aa, Homo sapiens; identical to SEQ ID NO: 51326

SEQ ID NO: 51328 - protein, 117 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPR

SEQ ID NO: 51329 - protein, 274 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYPKTCSKVEHFVSILGKCFESPWTTKALSETACEDSEENKQRITGAQTLPKHVSTSSDEGSPSASTPMINKTGFKFSAEKPVIEVPSMT

SEQ ID NO: 51330 - protein, 31 aa, Homo sapiens
MFTLAEVASLNDIQPTYRILKPWWDVFMDYL

SEQ ID NO: 51331 - protein, 187 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFALPNQEAKKEKKDPTGRKTNLDFQQYVFINQMCYHLALPWYSKYFPYLALIHTIILMVSSNFWFKYP

SEQ ID NO: 51332 - protein, 122 aa, Homo sapiens
MFTLAEVASLNDIQPTYRILKPWWDVFMDYLAVVMLMVAIFAGTMQLTKDQVVCLPVLPSPVNSKAHTPPGNAEVTTNIPKMEAATNQDQDGRTTNDISFGTSAVTPDIPLRATYPRTDFAL

SEQ ID NO: 51333 - protein, 796 aa, Homo sapiens
MIPVAEFKQFTEQQPAFKVLKPWWDVLAEYLTVAMLMIGVFGCTLQVTQDKIICLPNHELQENLSEAPCQQLLPRGIPEQIGALQEVKGLKNNLDLQQYSFINQLCYETALHWYAKYFPYLVVIHTLIFMVCTSFWFKFPGTSSKIEHFISILGKCFDSPWTTRALSEVSGENQKGPAATERAAATIVAMAGTGPGKAGEGEKEKVLAEPEKVVTEPPVVTLLDKKEGEQAKALFEKVKKFRMHVEEGDILYTMYIRQTVLKVCKFLAILVYNLVYVEKISFLVACRVETSEVTGYASFCCNHTKAHLFSKLAFCYISFVCIYGLTCIYTLYWLFHRPLKEYSFRSVREETGMGDIPDVKNDFAFMLHLIDQYDSLYSKRFAVFLSEVSESRLKQLNLNHEWTPEKLRQKLQRNAAGRLELALCMLPGLPDTVFELSEVESLRLEAICDITFPPGLSQLVHLQELSLLHSPARLPFSLQVFLRDHLKVMRVKCEELREVPLWVFGLRGLEELHLEGLFPQELARAATLESLRELKQLKVLSLRSNAGKVPASVTDVAGHLQRLSLHNDGARLVALNSLKKLAALRELELVACGLERIPHAVFSLGALQELDLKDNHLRSIEEILSFQHCRKLVTLRLWHNQIAYVPEHVRKLRSLEQLYLSYNKLETLPSQLGLCSGLRLLDVSHNGLHSLPPEVGLLQNLQHLALSYNALEALPEELFFCRKLRTLLLGDNQLSQLSPHVGALRALSRLELKGNRLEALPEELGNCGGLKKAGLLVEDTLYQGLPAEVRDKMEEE

SEQ ID NO: 51334 - protein, 522 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVKVNFAHFPRLISLHSLCLRRNKVAIVVSSLDWVWNLEKMDLSGNEIEYMEPHVFETVPHLQSLQLDSNRLTYIEPRILNSWKSLTSITLAGNLWDCGRNVCALASWLNNFQGRYDGNLQCASPEYAQGEDVLDAVYAFHLCEDGAEPTSGHLLSAVTNRSDLGPPASSATTLADGGEGQHDGTFEPATVALPGGEHAENAVQIHKVVTGTMALIFSFLIVVLVLYVSWKCFPASLRQLRQCFVTQRRKQKQKQTMHQMAAMSAQEYYVDYKPNHIEGALVIINEYGSCTCHQQPARECEV

SEQ ID NO: 51335 - protein, 522 aa, Homo sapiens; identical to SEQ ID NO: 51334

SEQ ID NO: 51336 - protein, 109 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAF

SEQ ID NO: 51337 - protein, 223 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQDCRSLKFLDIGYNQLKSLARNSFAGLFKLTELHLEHNDLVK

SEQ ID NO: 51338 - protein, 522 aa, Homo sapiens; identical to SEQ ID NO: 51334

SEQ ID NO: 51339 - protein, 522 aa, Homo sapiens; identical to SEQ ID NO: 51334

SEQ ID NO: 51340 - protein, 183 aa, Homo sapiens
MDFLLLGLCLYWLLRRPSGVVLCLLGACFQMLPAAPSGCPQLCRCEGRLLYCEALNLTEAPHNLSGLLGLSLRYNSLSELRAGQFTGLMQLTWLYLDHNHICSVQGDAFQKLRRVKELTLSSNQITQLPNTTFRPMPNLRSVDLSYNKLQALAPDLFHGLRKLTTLHMRANAIQFVPVRIFQD

SEQ ID NO: 51341 - protein, 516 aa, Homo sapiens
MGLHFKWPLGAPMLAAIYAMSMVLKMLPALGMACPPKCRCEKLLFYCDSQGFHSVPNATDKGSLGLSLRHNHITELERDQFASFSQLTWLHLDHNQISTVKEDAFQGLYKLKELILSSNKIFYLPNTTFTQLINLQNLDLSFNQLSSLHPELFYGLRKLQTLHLRSNSLRTIPVRLFWDCRSLEFLDLSTNRLRSLARNGFAGLIKLRELHLEHNQLTKINFAHFLRLSSLHTLFLQWNKISNLTCGMEWTWGTLEKLDLTGNEIKAIDLTVFETMPNLKILLMDNNKLNSLDSKILNSLRSLTTVGLSGNLWECSARICALASWLGSFQGRWEHSILCHSPDHTQGEDILDAVHGFQLCWNLSTTVTVMATTYRDPTTEYTKRISSSSYHVGDKEIPTTAGIAVTTEEHFPEPDNAIFTQRVITGTMALLFSFFFIIFIVFISRKCCPPTLRRIRQCSMVQNHRQLRSQTRLHMSNMSDQGPYNEYEPTHEGPFIIINGYGQCKCQQLPYKECEV

SEQ ID NO: 51342 - protein, 581 aa, Homo sapiens
MGFNVIRLLSGSAVALVIAPTVLLTMLSSAERGCPKGCRCEGKMVYCESQKLQEIPSSISAGCLGLSLRYNSLQKLKYNQFKGLNQLTWLYLDHNHISNIDENAFNGIRRLKELILSSNRISYFLNNTFRPVTNLRNLDLSYNQLHSLGSEQFRGLRKLLSLHLRSNSLRTIPVRIFQDCRNLELLDLGYNRIRSLARNVFAGMIRLKELHLEHNQFSKLNLALFPRLVSLQNLYLQWNKISVIGQTMSWTWSSLQRLDLSGNEIEAFSGPSVFQCVPNLQRLNLDSNKLTFIGQEILDSWISLNDISLAGNIWECSRNICSLVNWLKSFKGLRENTIICASPKELQGVNVIDAVKNYSICGKSTTERFDLARALPKPTFKPKLPRPKHESKPPLPPTVGATEPGPETDADAEHISFHKIIAGSVALFLSVLVILLVIYVSWKRYPASMKQLQQRSLMRRHRKKKRQSLKQMTPSTQEFYVDYKPTNTETSEMLLNGTGPCTYNKSGSRECEIPLSMNVSTFLAYDQPTISYCGVHHELLSHKSFETNAQEDTMETHLETELDLSTITTAGRISDHKQQLA

SEQ ID NO: 51343 - protein, 581 aa, Homo sapiens; identical to SEQ ID NO: 51342

SEQ ID NO: 51344 - protein, 518 aa, Homo sapiens
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEV

SEQ ID NO: 51345 - protein, 590 aa, Homo sapiens
MGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 51346 - protein, 590 aa, Homo sapiens; identical to SEQ ID NO: 51345

SEQ ID NO: 51347 - protein, 591 aa, Homo sapiens
MPGFHLITQLKGMSVVLVLLPTLLLVMLTGAQRACPKNCRCDGKIVYCESHAFADIPENISGGSQGLSLRFNSIQKLKSNQFAGLNQLIWLYLDHNYISSVDEDAFQGIRRLKELILSSNKITYLHNKTFHPVPNLRNLDLSYNKLQTLQSEQFKGLRKLIILHLRSNSLKTVPIRVFQDCRNLDFLDLGYNRLRSLSRNAFAGLLKLKELHLEHNQFSKINFAHFPRLFNLRSIYLQWNRIRSISQGLTWTWSSLHNLDLSGNDIQGIEPGTFKCLPNLQKLNLDSNKLTNISQETVNAWISLISITLSGNMWECSRSICPLFYWLKNFKGNKESTMICAGPKHIQGEKVSDAVETYNICSEVQVVNTERSHLVPQTPQKPLIIPRPTIFKPDVTQSTFETPSPSPGFQIPGAEQEYEHVSFHKIIAGSVALFLSVAMILLVIYVSWKRYPASMKQLQQHSLMKRRRKKARESERQMNSPLQEYYVDYKPTNSETMDISVNGSGPCTYTISGSRECEMPHHMKPLPYYSYDQPVIGYCQAHQPLHVTKGYETVSPEQDESPGLELGRDHSFIATIARSAAPAIYLERIAN

SEQ ID NO: 51348 - protein, 192 aa, Homo sapiens
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 51349 - protein, 291 aa, Homo sapiens
MGTPWRKRKGIAGPGLPDLSCALVLQPRAQVGTMSPAIALAFLPLVVTLLVRYRHYFRLLVRTVLLRSLRDCLSGLRIEERAFSYVLTHALPGDPGHILTTLDHWSSRCEYLSHMGPVKGQILMRLVEEKAPACVLELGTYCGYSTLLIARALPPGGRLLTVERDPRTAAVAEKLIRLAGFDEHMVELIVGSSEDVIPCLRTQYQLSRADLVLLAHRPRCYLRDLQLLEAHALLPAGATVLADHVLFPGAPRFLQYAKSCGRYRCRLHHTGLPDFPAIKDGIAQLTYAGPG

SEQ ID NO: 51350 - protein, 146 aa, Homo sapiens
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYR

SEQ ID NO: 51351 - protein, 251 aa, Homo sapiens
MGTPWRKRKGIAGPGLPDLSCALVLQPSLRDCLSGLRIEERAFSYVLTHALPGDPGHILTTLDHWSSRCEYLSHMGPVKGQILMRLVEEKAPACVLELGTYCGYSTLLIARALPPGGRLLTVERDPRTAAVAEKLIRLAGFDEHMVELIVGSSEDVIPCLRTQYQLSRADLVLLAHRPRCYLRDLQLLEAHALLPAGATVLADHVLFPGAPRFLQYAKSCGRYRCRLHHTGLPDFPAIKDGIAQLTYAGPG

SEQ ID NO: 51352 - protein, 291 aa, Homo sapiens; identical to SEQ ID NO: 51349

SEQ ID NO: 51353 - protein, 158 aa, Homo sapiens
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRVPGSVEMPHRPP

SEQ ID NO: 51354 - protein, 92 aa, Homo sapiens
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLT

SEQ ID NO: 51355 - protein, 192 aa, Homo sapiens; identical to SEQ ID NO: 51348

SEQ ID NO: 51356 - protein, 158 aa, Homo sapiens; identical to SEQ ID NO: 51353

SEQ ID NO: 51357 - protein, 104 aa, Homo sapiens
MNKRDYMNTSVQEPPLDYSFRSIHVIQDLVNEEPRTGLRPLKRSKSGKSLTQSLWLNNNVLNDLRDFNQVASQLLEHPENLAWIDLSFNDLTSIDPVLTTFFNL

SEQ ID NO: 51358 - protein, 174 aa, Homo sapiens
MVEFQPSVTDLVNEEPRTGLRPLKRSKSGKSLTQSLWLNNNVLNDLRDFNQVASQLLEHPENLAWIDLSFNDLTSIDPVLTTFFNLSVLYLHGNSIQRLGEVNKLAVLPRLRSLTLHGNPMEEEKGYRQYVLCTLSRITTFDFSGVTKADRTTAEVWKRMNIKPKKAWTKQNTL

SEQ ID NO: 51359 - protein, 1076 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRNKSENEKNRNQEDNKVKDLNQEIEKLKTQIKHFESLEEELKKMKSKNNDLQDNYLSEQNKNKLLASQLEEIKLQIKKQKELENGEVEGEDAFLSSKGRHERTKFRGHGSEASVSKHTARELSPQHKRERLRNREFALNNENYSLSNRQVSSPSFTNRRAAKASHMGVSTDSGTQETKKTEDRFVPGSSQSEGKKSREQPSVLSRYPPAAQEHSKAWKGTSKPGTESGLKGKVEKTTRTFSDTTHGSVPSDPLGRADKASDTSSETVFGKRGHVLGNGSQVTQAANSGCSKAIGALASSRRSSSEGLSKGKKAANGLEADNSCPNSKAPVLSKYPYSCRSQENILQGFSTSHKEGVNQPAAVVMEDSSPHEALRCRVIKSSGREKPDSDDDLDIASLVTAKLVNTTITPEPEPKPQPNSREKAKTRGAPRTSLFENDKDAGMENESVKSVRASTNTMELPDTNGAGVKSQRPFSPREALRSRAIIKPVIVDKDVKKIMGGSGTETTLEKQKPVSKPGPNKVTSSITIYPSDSSSPRAAPGEALRERHTSTSNIQVGLAELTSVSNHVSSPFELSIHKHDITLQLAEAERMADGPLKDRPETVVSRSSIIIKPSDPVERNSHAPPAETIRWKSHSAPSEVGFSDARHVTVRNAWKSRRDLKSLEDPPTRIGKNVESTNSNAYTQRSSTDFSELEQPRSCLFEQGTRRVGPSSGDAPEPSSRRTQSSLTVSEVLTRRNRVGDTITVAAWNHSASMEEEGEDCTLSVYRQLHNSLDPSELPGKQGLPESGRVRAEERLRPTRPCAEEN

SEQ ID NO: 51360 - protein, 1026 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRNKSENEKNRNQEDNKVKDLNQEIEKLKTQIKHFESLEEELKKMKSKNNDLQDNYLSEQNKNKLLASQLEEIKLQIKKQKELENGEVEGEDAFLSSKGRHERTKFRGHGSEASVSKHTARELSPQHKRERLRNREFALNNENYSLSNRQVSSPSFTNRRAAKASHMGVSTDSGTQETKKTEDRFVPGSSQSEGKKSREQPSVLSRYPPAAQEHSKAWKGTSKPGTESGLKGKVEKTTRTFSDTTHGSVPSDPLGRADKASDTSSETVFGKRGHVLGNGSQVTQAANSGCSKAIGALASSRRSSSEGLSKGKKAANGLEADNSCPNSKAPVLSKYPYSCRSQENILQGFSTSHKEGVNQPAAVVMEDSSPHEALRCRVIKSSGREKPDSDDDLDIASLVTAKLVNTTITPEPEPKPQPNSREKAKTRGAPRTSLFENDKDAGMENESVKSVRASTNTMELPDTNGAGVKSQRPFSPREALRSRAIIKPVIVDKDVKKIMGGSGTETTLEKQKPVSKPGPNKVTSSITIYPSDSSSPRAAPGEALRERHTSTSNIQVGLAELTSVSNHVSSPFELSIHKHDITLQLAEAERMADGPLKDRPETVVSRSSIIIKPSDPVERNSHAPPAETIRWKSHSAPSEVGFSDARHVTVRNAWKSRRDLKSLEDPPTRIGKNVESTNSNAYTQRSSTDFSELEQPRSCLFEQGTRRVGPSSGDAPEPSSRRTQSSLTVSEVLTRRNRVGDTITVAAWNHSASMSS

SEQ ID NO: 51361 - protein, 1076 aa, Homo sapiens; identical to SEQ ID NO: 51359

SEQ ID NO: 51362 - protein, 1076 aa, Homo sapiens; identical to SEQ ID NO: 51359

SEQ ID NO: 51363 - protein, 273 aa, Homo sapiens
MAEFTSYKETASSRHLRFKLQSLSRRLDELEEATKNLQKAEDELLDLQDKVIQAEGSNSSMLAEIEVLRQRVLRIEGKDEEIKRAEDLCRLMKEKLEEEENLTRELKSEIERLQKRMAELEKLEEAFSRSKNDCTQLCLSLNEERNLTKKISSELEMLRVKVKELESSEDRLDKTEQSLASELEKLKSLTLSFVSERKYLNEKEKENEKLIKELTQKLEQNKKMNRDYTRNASNLERNDLRIEDGISSTLPSKESRRKGGLDYLKQVENETRN

SEQ ID NO: 51364 - protein, 35 aa, Homo sapiens
MAEFTSYKETASSRHLRFKLQSLSRRLDELEEATK

SEQ ID NO: 51365 - protein, 346 aa, Homo sapiens
MKFSPAHYLLPLLPALVLSTRQDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 51366 - protein, 260 aa, Homo sapiens
MKSLQEALQNQLKETSEKAEKHQATINFLKTEVERKSKMIRDLQNENKSLKNKLLSGNKLCGIHAEESKKIQAQLKELRYGKKDLLFKAQQLTDLEQKLAVAKNELEKAALDRESQMKAMKETVQLCLTSVFRDQPPPPLSLITSNPTRMLLPPRNIASKLPDAAAKSKPQQSASGNNESSQVESTKEGNPSTTACDSQDEGRPCSMKHKESPPSNATAETEPIPQKLQMPPCSECEVKKAPEKPLTSFEGMAAREEKIL

SEQ ID NO: 51367 - protein, 299 aa, Homo sapiens
MAELGLNEHHQNEVINYMRFARSKRGLRLKTVDSCFQDLKESRLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKELEKKFQQTAAYRNMKEILTKKNDQIKDLRKRLAQYEPED

SEQ ID NO: 51368 - protein, 282 aa, Homo sapiens
MRFARSKRGLRLKTVDSCFQDLKESRLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKELEKKFQQTAAYRNMKEILTKKNDQIKDLRKRLAQYEPED

SEQ ID NO: 51369 - protein, 256 aa, Homo sapiens
MRNQDPGKMGRQRKSIKLYPTHPLVTFPRSWAKFQEKALLVEDTFTIDEVSEVLNGLQAVVHSEVESELINTAYTNVLLLRQLFAQAEKWYLKLQTDISELENRELLEQVAEFEKAEITSSNKKPILDVTKPKLAPLNEGGTAELLNKEILRLQEENEKLKSRLKTIEIQATNALDEKSKLEKALQDLQLDQGNQKDFIKAQDLSNLENTVAALKSEFQKTLNDKTENQKSLEENLATAKHDLLRVQEQLHMAEKI

SEQ ID NO: 51370 - protein, 146 aa, Homo sapiens
MVDELVLLLHALLMRHRALSIENSQLMEQLRLLVCERASLLRQVRPPSCPVPFPETFNGESSRLPEFIVQTASYMLVNENRFCNDAMKVAFLISLLTGEAEEWVVPYIEMDSPILGDYRAFLDEMKQCFGWDDDEDDDDEEEEDDY

SEQ ID NO: 51371 - protein, 739 aa, Homo sapiens
MASILLRSCRGRAPARLPPPPRYTVPRGSPGDPAHLSCASTLGLRNCLNVPFGCCTPIHPVYTSSRGDHLGCWALRPECLRIVSRAPWTSTSVGFVAVGPQCLPVRGWHSSRPVRDDSVVEKSLKSLKDKNKKLEEGGPVYSPPAEVVVKKSLGQRVLDELKHYYHGFRLLWIDTKIAARMLWRILNGHSLTRRERRQFLRICADLFRLVPFLVFVVVPFMEFLLPVAVKLFPNMLPSTFETQSLKEERLKKELRVKLELAKFLQDTIEEMALKNKAAKGSATKDFSVFFQKIRETGERPSNEEIMRFSKLFEDELTLDNLTRPQLVALCKLLELQSIGTNNFLRFQLTMRLRSIKADDKLIAEEGVDSLNVKELQAACRARGMRALGVTEDRLRGQLKQWLDLHLHQEIPTSLLILSRAMYLPDTLSPADQLKSTLQTLPEIVAKEAQVKVAEVEGEQVDNKAKLEATLQEEAAIQQEHREKELQKRSEVAKDFEPERVVAAPQRPGTEPQPEMPDTVLQSETLKDTAPVLEGLKEEEITKEEIDILSDACSKLQEQKKSLTKEKEELELLKEDVQDYSEDLQEIKKELSKTGEEKYVEESKASKRLTKRVQQMIGQIDGLISQLEMDQQAGKLAPANGMPTGENVISVAELINAMKQVKHIPESKLTSLAAALDENKDGKVNIDDLVKVIELVDKEDVHISTSQVAEIVATLEKEEKVEEKEKAKEKAEKEVAEVKS

SEQ ID NO: 51372 - protein, 252 aa, Homo sapiens
MRHTWPFRNVPFGCCTPIHPVYTSSRGDHLGCWALRPECLRIVSRAPWTSTSVGFVAVGPQCLPVRGWHSSRPVRDDSVVEKSLKSLKDKNKKLEEGGPVYSPPAEVVVKKSLGQRVLDELKHYYHGFRLLWIDTKIAARMLWRILNGHSLTRRERRQFLRICADLFRLVPFLVFVVVPFMEFLLPVAVKLFPNMLPSTFETQSLKEERLKKELRVKLELAKFLQDTIEEMALKNKAAKGSATKDFSVFFQK

SEQ ID NO: 51373 - protein, 1394 aa, Homo sapiens
MAALLRSARWLLRAGAAPRLPLSLRLLPGGPGRLHAASYLPAARAGPVAGGLLSPARLYAIAAKEKDIQEESTFSSRKISNQFDWALMRLDLSVRRTGRIPKKLLQKVFNDTCRSGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQIKNNNIDAAIENIENMLTSENKVIEPQYFGLAYLFRKVIEEQLEPAVEKISIMAERLANQFAIYKPVTDFFLQLVDAGKVDDARALLQRCGAIAEQTPILLLFLLRNSRKQGKASTVKSVLELIPELNEKEEAYNSLMKSYVSEKDVTSAKALYEHLTAKNTKLDDLFLKRYASLLKYAGEPVPFIEPPESFEFYAQQLRKLRENSS

SEQ ID NO: 51374 - protein, 1087 aa, Homo sapiens
MPPPICPPLAPGPWPGGLGGSHALLLLRSCGSLLPELKLEERTEFAHRIWDTLQKLGAVYDVSHYNALLKVYLQNEYKFSPTDFLAKMEEANIQPNRVTYQRLIASYCNVGDIEGASKILGFMKTKDLPVTEAVFSALVTGHARAGDMENAENILTVMRDAGIEPGPDTYLALLNAYAEKGDIDHVKQTLEKVEKSELHLMDRDLLQIIFSFSKAGYPQYVSEILEKVTCERRYIPDAMNLILLLVTEKLEDVALQILLACPVSKEDGPSVFGSFFLQHCVTMNTPVEKLTDYCKKLKEVQMHSFPLQFTLHCALLANKTDLAKALMKAVKEEGFPIRPHYFWPLLVGRRKEKNVQGIIEILKGMQELGVHPDQETYTDYVIPCFDSVNSARAILQENGCLSDSDMFSQAGLRSEAANGNLDFVLSFLKSNTLPISLQSIRSSLLLGFRRSMNINLWSEITELLYKDGRYCQEPRGPTEAVGYFLYNLIDSMSDSEVQAKEEHLRQYFHQLEKMNVKIPENIYRGIRNLLESYHVPELIKDAHLLVESKNLDFQKTVQLTSSELESTLETLKAENQPIRDVLKQLILVLCSEENMQKALELKAKYESDMVTGGYAALINLCCRHDKVEDALNLKEEFDRLDSSAVLDTGKYVGLVRVLAKHGKLQDAINILKEMKEKDVLIKDTTALSFFHMLNGAALRGEIETVKQLHEAIVTLGLAEPSTNISFPLVTVHLEKGDLSTALEVAIDCYEKYKVLPRIHDVLCKLVEKGETDLIQKAMDFVSQEQGEMVMLYDLFFAFLQTGNYKEAKKIIETPGIRARSARLQWFCDRCVANNQVETLEKLVELTQKLFECDRDQMYYNLLKLYKINGDWQRADAVWNKIQEENVIPREKTLRLLAEILREGNQEVPFDVPELWYEDEKHSLNSSSASTTEPDFQKDILIACRLNQKKGAYDIFLNAKEQNIVFNAETYSNLIKLLMSEDYFTQAMEVKAFAETHIKGFTLNDAANSRLIITQVRRDYLKEAVTTLKTVLDQQQTPSRLAVTRVIQALAMKGDVENIEVVQKMLNGLEDSIGLSKMVFINNIALAQ

SEQ ID NO: 51375 - protein, 951 aa, Homo sapiens
MPGPLGLLCFLALGLLGSAGPSGAAPPLCAAPCSCDGDRRVDCSGKGLTAVPEGLSAFTQALDISMNNITQLPEDAFKNFPFLEELQLAGNDLSFIHPKALSGLKELKVLTLQNNQLKTVPSEAIRGLSALQSLRLDANHITSVPEDSFEGLVQLRHLWLDDNSLTEVPVHPLSNLPTLQALTLALNKISSIPDFAFTNLSSLVVLHLHNNKIRSLSQHCFDGLDNLETLDLNYNNLGEFPQAIKALPSLKELGFHSNSISVIPDGAFDGNPLLRTIHLYDNPLSFVGNSAFHNLSDLHSLVIRGASMVQQFPNLTGTVHLESLTLTGTKISSIPNNLCQEQKMLRTLDLSYNNIRDLPSFNGCHALEEISLQRNQIYQIKEGTFQGLISLRILDLSRNLIHEIHSRAFATLGPITNLDVSFNELTSFPTEGLNGLNQLKLVGNFKLKEALAAKDFVNLRSLSVPYAYQCCAFWGCDSYANLNTEDNSLQDHSVAQEKGTADAANVTSTLENEEHSQIIIHCTPSTGAFKPCEYLLGSWMIRLTVWFIFLVALFFNLLVILTTFASCTSLPSSKLFIGLISVSNLFMGIYTGILTFLDAVSWGRFAEFGIWWETGSGCKVAGFLAVFSSESAIFLLMLATVERSLSAKDIMKNGKSNHLKQFRVAALLAFLGATVAGCFPLFHRGEYSASPLCLPFPTGETPSLGFTVTLVLLNSLAFLLMAVIYTKLYCNLEKEDLSENSQSSMIKHVAWLIFTNCIFFCPVAFFSFAPLITAISISPEIMKSVTLIFFPLPACLNPVLYVFFNPKFKEDWKLLKRRVTKKSGSVSVSISSQGGCLEQDFYYDCGMYSHLQGNLTVCDCCESFLLTKPVSCKHLIKSHSCPALAVASCQRPEGYWSDCGTQSAHSDYADEEDSFVSDSSDQVQACGRACFYQSRGFPLVRYAYNLPRVKD

SEQ ID NO: 51376 - protein, 907 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 51377 - protein, 777 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLLPHDDHCLHQALLQFGQGRPGEYLGLLYGKTHCPVALHQLHPKLPCGFLVLLLFNKPYIYQS

SEQ ID NO: 51378 - protein, 835 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLHLHNNRIHSLGKKCFDGLHSLETLDLNYNNLDEFPTAIRTLSNLKELGFHSNNIRSIPEKAFVGNPSLITIHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 51379 - protein, 883 aa, Homo sapiens
MDTSRLGVLLSLPVLLQLATGGSSPRSGVLLRGCPTHCHCEPDGRMLLRVDCSDLGLSELPSNLSVFTSYLDLSMNNISQLLPNPLPSLRFLEELRLAGNALTYIPKGAFTGLYSLKVLMLQNNQLRHVPTEALQNLRSLQSLRLDANHISYVPPSCFSGLHSLRHLWLDDNALTEIPVQAFRSLSALQAMTLALNKIHHIPDYAFGNLSSLVVLHLHNNRIHSLGKKCFDGLHSLETLDLNYNNLDEFPTAIRTLSNLKELHFYDNPIQFVGRSAFQHLPELRTLTLNGASQITEFPDLTGTANLESLTLTGAQISSLPQTVCNQLPNLQVLDLSYNLLEDLPSFSVCQKLQKIDLRHNEIYEIKVDTFQQLLSLRSLNLAWNKIAIIHPNAFSTLPSLIKLDLSSNLLSSFPITGLHGLTHLKLTGNHALQSLISSENFPELKVIEMPYAYQCCAFGVCENAYKISNQWNKGDNSSMDDLHKKDAGMFQAQDERDLEDFLLDFEEDLKALHSVQCSPSPGPFKPCEHLLDGWLIRIGVWTIAVLALTCNALVTSTVFRSPLYISPIKLLIGVIAAVNMLTGVSSAVLAGVDAFTFGSFARHGAWWENGVGCHVIGFLSIFASESSVFLLTLAALERGFSVKYSAKFETKAPFSSLKVIILLCALLALTMAAVPLLGGSKYGASPLCLPLPFGEPSTMGYMVALILLNSLCFLMMTIAYTKLYCNLDKGDLENIWDCSMVKHIALLLFTNCILNCPVAFLSFSSLINLTFISPEVIKFILLVVVPLPACLNPLLYILFNPHFKEDLVSLRKQTYVWTRSKHPSLMSINSDDVEKQSCDSTQALVTFTSSSITYDLPPSSVPSPAYPVTESCHLSSVAFVPCL

SEQ ID NO: 51380 - protein, 915 aa, Homo sapiens
MGRPRLTLVCQVSIIISARDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 51381 - protein, 232 aa, Homo sapiens
MNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLDLNYNKLQEFPVAIRTLGRLQELSLNGAMDIQEFPDLKGTTSLEILTLTRAGIRLLPSGMCQQLPRLRVLELSHNQIEELPSLHRCQKLEE

SEQ ID NO: 51382 - protein, 967 aa, Homo sapiens
MPSPPGLRALWLCAALCASRRAGGAPQPGPGPTACPAPCHCQEDGIMLSADCSELGLSAVPGDLDPLTAYLDLSMNNLTELQPGLFHHLRFLEELRLSGNHLSHIPGQAFSGLYSLKILMLQNNQLGGIPAEALWELPSLQSLRLDANLISLVPERSFEGLSSLRHLWLDDNALTEIPVRALNNLPALQAMTLALNRISHIPDYAFQNLTSLVVLHLHNNRIQHLGTHSFEGLHNLETLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 51383 - protein, 75 aa, Homo sapiens
MLSADCSELGLSAVPGDLDPLTAYLAVPGMVAEGKADRTGGGGSSRPEKTRRSLEEAIDRTIGGAQELWAPEVSS

SEQ ID NO: 51384 - protein, 828 aa, Homo sapiens
MRLEGEGRSARAGQNLSRAGSARRGAPRDLSMNNLTELQPGLFHHLRFLEELRLSGNHLSHIPGQAFSGLYSLKILMLQNNQLGGIPAEALWELPSLQSLDLNYNKLQEFPVAIRTLGRLQELGFHNNNIKAIPEKAFMGNPLLQTIHFYDNPIQFVGRSAFQYLPKLHTLSLNGAMDIQEFPDLKGTTSLEILTLTRAGIRLLPSGMCQQLPRLRVLELSHNQIEELPSLHRCQKLEEIGLQHNRIWEIGADTFSQLSSLQALDLSWNAIRSIHPEAFSTLHSLVKLDLTDNQLTTLPLAGLGGLMHLKLKGNLALSQAFSKDSFPKLRILEVPYAYQCCPYGMCASFFKASGQWEAEDLHLDDEESSKRPLGLLARQAENHYDQDLDELQLEMEDSKPHPSVQCSPTPGPFKPCEYLFESWGIRLAVWAIVLLSVLCNGLVLLTVFAGGPVPLPPVKFVVGAIAGANTLTGISCGLLASVDALTFGQFSEYGARWETGLGCRATGFLAVLGSEASVLLLTLAAVQCSVSVSCVRAYGKSPSLGSVRAGVLGCLALAGLAAALPLASVGEYGASPLCLPYAPPEGQPAALGFTVALVMMNSFCFLVVAGAYIKLYCDLPRGDFEAVWDCAMVRHVAWLIFADGLLYCPVAFLSFASMLGLFPVTPEAVKSVLLVVLPLPACLNPLLYLLFNPHFRDDLRRLRPRAGDSGPLAYAAAGELEKSSCDSTQALVAFSDVDLILEASEAGRPPGLETYGFPSVTLISCQQPGAPRLEGSHCVEPEGNHFGNPQPSMDGELLLRAEGSTPAGGGLSGGGGFQPSGLAFASHV

SEQ ID NO: 51385 - protein, 2012 aa, Homo sapiens
METLNGAGDTGGKPSTRGGDPAARSRRTEGIRAAYRRGDRGGARDLLEEACDQCASQLEKGQLLSIPAAYGDLEMVRYLLSKRLVELPTEPTDDNPAVVAAYFGHTAVVQELLEPLTPKQTEWEQTAPFSGTFPLSCHLLPGPCSPQRLLNWMLALACQRGHLGVVKLLVLTHGADPESYAVRKNEFPVIVRLPLYAAIKSGNEDIAIFLLRHGAYFCSYILLDSPDPSKHLLRKYFIEASPLPSSYPGKTALRVKWSHLRLPWVDLDWLIDISCQITELDLSANCLATLPSVIPWGLINLRKLNLSDNHLGELPGVQSSDEIICSRLLEIDISSNKLSHLPPGFLHLSKLQKLTASKNCLEKLFEEENATNWIGLRKLQELDISDNKLTELPALFLHSFKSLNSLNVSRNNLKVFPDPWACPLKCCKASRNALECLPDKMAVFWKNHLKDVDFSENALKEVPLGLFQLDALMFLRLQGNQLAALPPQEKWTCRQLKTLDLSRNQLGKNEDGLKTKRIAFFTTRGRQRSGTEAASVLEFPAFLSESLEVLCLNDNHLDTVPPSVCLLKSLSELYLGNNPGLRELPPELGQLGNLWQLDTEDLTISNVPAEIQKEGPKAMLSYLRAQLRKAEKCKLMKMIIVGPPRQGKSTLLEILQTGRAPQVVHGEATIRTTKWELQRPAGSRAKVESVEFNVWDIGGPASMATVNQCFFTDKALYVVVWNLALGEEAVANLQFWLLNIEAKAPNAVVLVVGTHLDLIEAKFRVERIATLRAYVLALCRSPSGSRATGFPDITFKHLHEISCKSLEGQEGLRQLIFHVTCSMKDVGSTIGCQRLAGRLIPRSYLSLQEAVLAEQQRRSRDDDVQYLTDRQLEQLVEQTPDNDIKDYEDLQSAISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMRHPTANTIQRVFKMSFVPVGFWQRFIARMLISLAEMDLQLFENKKNTKSRNRKVTIYSFTGNQRNRCSTFRVKRNQTIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGVLVDAAVVAKDTVVCTFENENTEWCLAVWRGWGAREFDIFYQSYEELGRLEACTRKRR

SEQ ID NO: 51386 - protein, 2015 aa, Homo sapiens
MAGMSQRPPSMYWCVGPEESAVCPERAMETLNGAGDTGGKPSTRGGDPAARSRRTEGIRAAYRRGDRGGARDLLEEACDQCASQLEKGQLLSIPAAYGDLEMVRYLLSKRLVELPTEPTDDNPAVVAAYFGHTAVVQELLESLPGPCSPQRLLNWMLALACQRGHLGVVKLLVLTHGADPESYAVRKNEFPVIVRLPLYAAIKSGNEDIAIFLLRHGAYFCSYILLDSPDPSKHLLRKYFIEASPLPSSYPGKTALRVKWSHLRLPWVDLDWLIDISCQITELDLSANCLATLPSVIPWGLINLRKLNLSDNHLGELPGVQSSDEIICSRLLEIDISSNKLSHLPPGFLHLSKLQKLTASKNCLEKLFEEENATNWIGLRKLQELDISDNKLTELPALFLHSFKSLNSLNVSRNNLKVFPDPWACPLKCCKASRNALECLPDKMAVFWKNHLKDVDFSENALKEVPLGLFQLDALMFLRLQGNQLAALPPQEKWTCRQLKTLDLSRNQLGKNEDGLKTKRIAFFTTRGRQRSGTEAASVLEFPAFLSESLEVLCLNDNHLDTVPPSVCLLKSLSELYLGNNPGLRELPPELGQLGNLWQLDTEDLTISNVPAEIQKEGPKAMLSYLRAQLRKAEKCKLMKMIIVGPPRQGKSTLLEILQTGRAPQVVHGEATIRTTKWELQRPAGSRAKVESVEFNVWDIGGPASMATVNQCFFTDKALYVVVWNLALGEEAVANLQFWLLNIEAKAPNAVVLVVGTHLDLIEAKFRVERIATLRAYVLALCRSPSGSRATGFPDITFKHLHEISCKSLEGQEGLRQLIFHVTCSMKDVGSTIGCQRLAGRLIPRSYLSLQEAVLAEQQRRSRDDDVQYLTDRQLEQLVEQTPDNDIKDYEDLQSAISFLIETGTLLHFPDTSHGLRNLYFLDPIWLSECLQRIFNIKGSRSVAKNGVIRAEDLRMLLVGTGFTQQTEEQYFQFLAKFEIALPVANDSYLLPHLLPSKPGLDTHGMRHPTANTIQRVFKMSFVPVGFWQRFIARMLISLAEMDLQLFENKKNTKSRNRKVTIYSFTGNQRNRCSTFRVKRNQTIYWQEGLLVTFDGGYLSVESSDVNWKKKKSGGMKIVCQSEVRDFSAMAFITDHVNSLIDQWFPALTATESDGTPLMEQYVPCPVCETAWAQHTDPSEKSEDVQYFDMEDCVLTAIERDFISCPRHPDLPVPLQELVPELFMTDFPARLFLENSKLEHSEDEGSVLGQGGSGTVIYRARYQGQPVAVKRFHIKKFKNFANVPADTMLRHLRATDAMKNFSEFRQEASMLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGVLVDAAVVAKDTVVCTFENENTEWCLAVWRGWGAREFDIFYQSYEELGRLEACTRKRR

SEQ ID NO: 51387 - protein, 674 aa, Homo sapiens
MLHALQHPCIVALIGISIHPLCFALELAPLSSLNTVLSENARDSSFIPLGHMLTQKIAYQIASGLAYLHKKNIIFCDLKSDNILVWSLDVKEHINIKLSDYGISRQSFHEGALGVEGTPGYQAPEIRPRIVYDEKVDMFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRGGDVIVIGLEKDSGAQRGRVIAVLKARELTPHGIMPVSSVKVCWAGWPVRDMVYMVAVM

SEQ ID NO: 51388 - protein, 32 aa, Homo sapiens
MAGMSQRPPSMYWCVGPEESAVCPERAMETLN

SEQ ID NO: 51389 - protein, 501 aa, Homo sapiens
MFSYGMVLYELLSGQRPALGHHQLQIAKKLSKGIRPVLGQPEEVQFRRLQALMMECWDTKPEKRPLALSVVSQMKDPTFATFMYELCCGKQTAFFSSQGQEYTVVFWDGKEESRNYTVVNTEKGLMEVQRMCCPGMKVSCQLQVQRSLWTATEDQKIYIYTLKGMCPLNTPQQALDTPAVVTCFLAVPVIKKNSYLVLAGLADGLVAVFPVVRGTPKDSCSYLCSHTANRSKFSIADEDARQNPYPVKAMEVVNSGSEVWYSNGPGLLVIDCASLEICRRLEPYMAPSMVTSVVCSSEGRGEEVVWCLDDKANSLVMYHSTTYQLCARYFCGVPSPLRDMFPVRPLDTEPPAASHTANPKVPEGDSIADVSIMYSEELGTQILIHQESLTDYCSMSSYSSSPPRQAARSPSSLPSSPASSSSVPFSTDCEDSDMLHTPGAASDRSEHDLTPMDGETFSQHLQAVKILAVRDLIWVPRRVEMLSSLAWRRILAPSGAESLPS

SEQ ID NO: 51390 - protein, 2527 aa, Homo sapiens
MASGSCQGCEEDEETLKKLIVRLNNVQEGKQIETLVQILEDLLVFTYSERASKLFQGKNIHVPLLIVLDSYMRVASVQQVGWSLLCKLIEVCPGTMQSLMGPQDVGNDWEVLGVHQLILKMLTVHNASVNLSVIGLKTLDLLLTSGKITLLILDEESDIFMLIFDAMHSFPANDEVQKLGCKALHVLFERVSEEQLTEFVENKDYMILLSALTNFKDEEEIVLHVLHCLHSLAIPCNNVEVLMSGNVRCYNIVVEAMKAFPMSERIQEVSCCLLHRLTLGNFFNILVLNEVHEFVVKAVQQYPENAALQISALSCLALLTETIFLNQDLEEKNENQENDDEGEEDKLFWLEACYKALTWHRKNKHVQEAACWALNNLLMYQNSLHEKIGDEDGHFPAHREVMLSMLMHSSSKEVFQASANALSTLLEQNVNFRKILLSKGIHLNVLELMQKHIHSPEVAESGCKMLNHLFEGSNTSLDIMAAVVPKILTVMKRHETSLPVQLEALRAILHFIVPGMPEESREDTEFHHKLNMVKKQCFKNDIHKLVLAALNRFIGNPGIQKCGLKVISSIVHFPDALEMLSLEGAMDSVLHTLQMYPDDQEIQCLGLSLIGYLITKKNVFIGTGHLLAKILVSSLYRFKDVAEIQTKGFQTILAILKLSASFSKLLVHHSFDLVIFHQMSSNIMEQKDQQFLNLCCKCFAKVAMDDYLKNVMLERACDQNNSIMVECLLLLGADANQAKEGSSLICQVCEKESSPKLVELLLNSGSREQDVRKALTISIGKGDSQIISLLLRRLALDVANNSICLGGFCIGKVEPSWLGPLFPDKTSNLRKQTNIASTLARMVIRYQMKSAVEEGTASGSDGNFSEDVLSKFDEWTFIPDSSMDSVFAQSDDLDSEGSEGSFLVKKKSNSISVGEFYRDAVLQRCSPNLQRHSNSLGPIFDHEDLLKRKRKILSSDDSLRSSKLQSHMRHSDSISSLASEREYITSLDLSANELRDIDALSQKCCISVHLEHLEKLELHQNALTSFPQQLCETLKSLTHLDLHSNKFTSFPSYLLKMSCIANLDVSRNDIGPSVVLDPTVKCPTLKQFNLSYNQLSFVPENLTDVVEKLEQLILEGNKISGICSPLRLKELKILNLSKNHISSLSENFLEACPKVESFSARMNFLAAMPFLPPSMTILKLSQNKFSCIPEAILNLPHLRSLDMSSNDIQYLPGPAHWKSLNLRELLFSHNQISILDLSEKAYLWSRVEKLHLSHNKLKEIPPEIGCLENLTSLDVSYNLELRSFPNEMGKLSKIWDLPLDELHLNFDFKHIGCKAKDIIRFLQQRLKKAVPYNRMKLMIVGNTGSGKTTLLQQLMKTKKSDLGMQSATVGIDVKDWPIQIRDKRKRDLVLNVWDFAGREEFYSTHPHFMTQRALYLAVYDLSKGQAEVDAMKPWLFNIKARASSSPVILVGTHLDVSDEKQRKACMSKITKELLNKRGFPAIRDYHFVNATEESDALAKLRKTIINESLNFKIRDQLVVGQLIPDCYVELEKIILSERKNVPIEFPVIDRKRLLQLVRENQLQLDENELPHAVHFLNESGVLLHFQDPALQLSDLYFVEPKWLCKIMAQILTVKVEGCPKHPKGIISRRDVEKFLSKKRKFPKNYMSQYFKLLEKFQIALPIGEEYLLVPSSLSDHRPVIELPHCENSEIIIRLYEMPYFPMGFWSRLINRLLEISPYMLSGRERALRPNRMYWRQGIYLNWSPEAYCLVGSEVLDNHPESFLKITVPSCRKGCILLGQVVDHIDSLMEEWFPGLLEIDICGEGETLLKKWALYSFNDGEEHQKILLDDLMKKAEEGDLLVNPDQPRLTIPISQIAPDLILADLPRNIMLNNDELEFEQAPEFLLGDGSFGSVYRAAYEGEEVAVKIFNKHTSLRLLRQELVVLCHLHHPSLISLLAAGIRPRMLVMELASKGSLDRLLQQDKASLTRTLQHRIALHVADGLRYLHSAMIIYRDLKPHNVLLFTLYPNAAIIAKIADYGIAQYCCRMGIKTSEGTPGFRAPEVARGNVIYNQQADVYSFGLLLYDILTTGGRIVEGLKFPNEFDELEIQGKLPDPVKEYGCAPWPMVEKLIKQCLKENPQERPTSAQVFDILNSAELVCLTRRILLPKNVIVECMVATHHNSRNASIWLGCGHTDRGQLSFLDLNTEGYTSEEVADSRILCLALVHLPVEKESWIVSGTQSGTLLVINTEDGKKRHTLEKMTDSVTCLYCNSFSKQSKQKNFLLVGTADGKLAIFEDKTVKLKGAAPLKILNIGNVSTPLMCLSESTNSTERNVMWGGCGTKIFSFSNDFTIQKLIETRTSQLFSYAAFSDSNIITVVVDTALYIAKQNSPVVEVWDKKTEKLCGLIDCVHFLREVMVKENKESKHKMSYSGRVKTLCLQKNTALWIGTGGGHILLLDLSTRRLIRVIYNFCNSVRVMMTAQLGSLKNVMLVLGYNRKNTEGTQKQKEIQSCLTVWDINLPHEVQNLEKHIEVRKELAEKMRRTSVE

SEQ ID NO: 51391 - protein, 193 aa, Homo sapiens
MTSSCFRSTTRRSLSSQTAQRLVCPQFINGTAKDSILTSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFFFASSFKGKTKIFEHIIVDLSL

SEQ ID NO: 51392 - protein, 545 aa, Homo sapiens
MALRRGGCGALGLLLLLLGAACLIPRSAQVRRLARCPATCSCTKESIICVGSSWVPRIVPGDISSLSLVNGTFSEIKDRMFSHLPSLQLLLLNSNSFTIIRDDAFAGLFHLEYLFIEGNKIETISRNAFRGLRDLTHLSLANNHIKALPRDVFSDLDSLIELDLRGNKFECDCKAKWLYLWLKMTNSTVSDVLCIGPPEYQEKKLNDVTSFDYECTTTDFVVHQTLPYQSVSVDTFNSKNDVYVAIAQPSMENCMVLEWDHIEMNFRSYDNITGQSIVGCKAILIDDQVFVVVAQLFGGSHIYKYDESWTKFVKFQDIEVSRISKPNDIELFQIDDETFFVIADSSKAGLSTVYKWNSKGFYSYQSLHEWFRDTDAEFVDIDGKSHLILSSRSQVPIILQWNKSSKKFVPHGDIPNMEDVLAVKSFRMQNTLYLSLTRFIGDSRVMRWNSKQFVEIQALPSRGAMTLQPFSFKDNHYLALGSDYTFSQIYQWDKEKQLFKKFKEIYVQAPRSFTAVSTDRRDFFFASSFKGKTKIFEHIIVDLSL

SEQ ID NO: 51393 - protein, 548 aa, Homo sapiens
MAGLRARGGPGPGLLALSALGFCLMLQVSAKRPPKTPPCPPSCSCTRDTAFCVDSKAVPRNLPSEVISLTLVNAAFSEIQDGAFSHLPLLQFLLLNSNKFTLIGDNAFTGLSHLQYLFIENNDIWALSKFTFRGLKSLTHLSLANNNLQTLPRDIFRPLDILNDLDLRGNSLNCDCKVKWLVEWLAHTNTTVAPIYCASPPRFQEHKVQDLPLREFDCITTDFVLYQTLAFPAVSAEPFLYSSDLYLALAQPGVSACTILKWDYVERQLRDYDRIPAPSAVHCKPMVVDSQLYVVVAQLFGGSYIYHWDPNTTRFTRLQDIDPQRVRKPNDLEAFRIDGDWYFAVADSSKAGATSLYRWHQNGFYSHQALHPWHRDTDLEFVDGEGKPRLIVSSSSQAPVIYQWSRTQKQFVAQGEVTQVPDAQAVKHFRAGRDSYLCLSRYIGDSKILRWEGTRFSEVQALPSRGSLALQPFLVGGRRYLALGSDFSFTQIYQWDEGRQKFVRFQELAVQAPRAFCYMPAGDAQLLLAPSFKGQTLVYRHIVVDLSA

SEQ ID NO: 51394 - protein, 537 aa, Homo sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 51395 - protein, 494 aa, Homo sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPGEPPPRPSACPAACLAGLTCLPTSPQRPPWCPASHWCWARASSCWLPACGGAHSCGPGPVPACAWPQRRPWPRGGCCGPMTPSSCGWKGNPASWWPMPPRRAAPRCCAATGPAFTRTRACTPGTGTRTLRPWSWTAGPTCCWPRLPSGPCSSTGPVAASRDAQTSPRPRMSMPHATSRLVGTCSCASHATLGTPWSCAGTAPCFVCCSNFPRAVPTSSSHCSSPGTSWPS

SEQ ID NO: 51396 - protein, 538 aa, Homo sapiens
MGGAGILLLLLAGAGVVVAWRPPKGKCPLRCSCSKDSALCEGSPDLPVSFSPTLLSLSLVRTGVTQLKAGSFLRIPSLHLLLFTSNSFSVIEDDAFAGLSHLQYLFIEDNEIGSISKNALRGLRSLTHLSLANNHLETLPRFLFRGLDTLTHVDLRGNPFQCDCRVLWLLQWMPTVNASVGTGACAGPASLSHMQLHHLDPKTFKCRAIELSWFQTVGESALSVEPFSYQGEPHIVLAQPFAGRCLILSWDYSLQRFRPEEELPAASVVSCKPLVLGPSLFVLAARLWGGSQLWARPSPGLRLAPTQTLAPRRLLRPNDAELLWLEGQPCFVVADASKAGSTTLLCRDGPGFYPHQSLHAWHRDTDAEALELDGRPHLLLASASQRPVLFHWTGGRFERRTDIPEAEDVYATRHFQAGGDVFLCLTRYIGDSMVVMRWDGSMFRLLQQLPSRGAHVFQPLLIARDQLAILGSDFAFSQVLRLEPDKGLLEPLQELGPPALVAPRAFAHITMAGRRFLFAACFKGPTQIYQHHEIDLSA

SEQ ID NO: 51397 - protein, 696 aa, Homo sapiens
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEEKLCLPHHILEEKGLVKVGITIQALLDITVTKALFT

SEQ ID NO: 51398 - protein, 728 aa, Homo sapiens
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 51399 - protein, 763 aa, Homo sapiens
MATPGSEPQPFVPALSVATLHPLHHPHHHHHHHQHHGGTGAPGGAGGGGGGSGGFNLPLNRGLERALEEAANSGGLNLSARKLKEFPRTAAPGHDLSDTVQADLSKNRLVEVPMELCHFVSLEILNLYHNCIRVIPEAIVNLQMLTYLNLSRNQLSALPACLCGLPLKVLIASNNKLGSLPEEIGQLKQLMELDVSCNEITALPQQIGQLKSLRELNVRRNYLKVLPQELVDLSLVKFDFSCNKVLVIPICFREMKQLQVLLLENNPLQSPPAQICTKGKVHIFKYLSIQACQIKTADSLYLHTMERPHLHQHVEDGKKDSDSGVGSDNGDKRLSATEPSDEDTVSLNVPMSNIMEEEQIIKEDSCHRLSPVKGEFHQEFQPEPSLLGDSTNSGEERDQFTDRADGLHSEFMNYKARAEDCEELLRIEEDVHWQTEGIISSSKDQDMDIAMIEQLREAVDLLQDPNGLSTDITERSVLNLYPMGSAEALELQDSALNGQIQLETSPVCEVQSDLTLQSNGSQYSPNEIRENSPAVSPTTNSTAPFGLKPRSDPALILPPISFNTLTQAQTWDSSSYSVPSEGDSDNVFLRPQRNLESIDPQFTIRRKMEQMREEKELVEQLRESIEMRLKVSLHEDLGAALMDGVVLCHLVNHIRPRSVASIHVPSPAVPKLSMAKCRRNVENFLEACRKLGVPEADLCSPCDILQLDFRHIRKTVDTLLALGEKAPPPTSALRSRDLIGFCLVHILFIVLVYITYHWNALSA

SEQ ID NO: 51400 - protein, 1093 aa, Homo sapiens
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 51401 - protein, 996 aa, Homo sapiens
NLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAARERRMHVMPDDDVFFITDVKIDDAGVYSCTAQNSAGSISANATLTVLETPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 51402 - protein, 1070 aa, Homo sapiens
MARPVRGGLGAPRRSPCLLLLWLLLLRLEPVTAAAGPRAPCAAACTCAGDSLDCGGRGLAALPGDLPSWTRSLNLSYNKLSEIDPAGFEDLPNLQEVYLNNNELTAVPSLGAASSHVVSLFLQHNKIRSVEGSQLKAYLSLEVLDLSLNNITEVRNTCFPHGPPIKELNLAGNRIGTLELGAFDGLSRSLLTLRLSKNRITQLPVRAFKLPRLTQLDLNRNRIRLIEGLTFQGLNSLEVLKLQRNNISKLTDGAFWGLSKMHVLHLEYNSLVEVNSGSLYGLTALHQLHLSNNSIARIHRKGWSFCQKLHELVLSFNNLTRLDEESLAELSSLSVLRLSHNSISHIAEGAFKGLRSLRVLDLDHNEISGTIEDTSGAFSGLDSLSKLLLLEPSQSAGCSSPSQPHMSAGGRTLFGNKIKSVAKRAFSGLEGLEHLNLGGNAIRSVQFDAFVKMKNLKELHISSDSFLCDCQLKWLPPWLIGRMLQAFVTATCAHPESLKGQSIFSVPPESFVCDDFLKPQIITQPETTMAMVGKDIRFTCSAASSSSSPMTFAWKKDNEVLTNADMENFVHVHAQDGEVMEYTTILHLRQVTFGHEGRYQCVITNHFGSTYSHKARLTVNVLPSFTKTPHDITIRTTTMARLECAATGHPNPQIAWQKDGGTDFPAAQTPSLVVPLEDRVVSVGETVALQCKATGNPPPRITWFKGDRPLSLTERHHLTPDNQLLVVQNVVAEDAGRYTCEMSNTLGTERAHSQLSVLPAAGCRKDGTTVGIFTIAVVSSIVLTSLVWVCIIYQTRKKSEEYSVTNTDETVVPPDVPSYLSSQGTLSDRQETVVRTEGGPQANGHIESNGVCPRDASHFPEPDTHSVACRQPKLCAGSAYHKEPWKAMEKAEGTPGPHKMEHGGRVVCSDCNTEVDCYSRGQAFHPQPVSRDSAQPSAPNGPEPGGSDQEHSPHHQCSRTAAGSCPECQGSLYPSNHDRMLTAVKKKPMASLDGKGDSSWTLARLYHPDSTELQPASSLTSGSPERAEAQYLLVSNGHLPKACDASPESTPLTGQLPGKQRVPLLLAPKS

SEQ ID NO: 51403 - protein, 1065 aa, Homo sapiens
MAPAPLGVPEEQLLGCRSRVLSRLLFIAQTALLLLPAAGAGLCPAPCSCRIPLLDCSRRKLPAPSWRALSGLLPPDTAILDFSHNRLSNWNISLESQTLQEVKMNYNELTEIPYFGEPTSNITLLSLVHNIIPEINAQALQFYPALESLDLSSNIISEIKTSSFPRMQLKYLNLSNNRITTLEAGCFDNLSSSLLVVKLNRNRMSMIPPKIFKLPHLQFLELKRNRIKIVEGLTFQGLDSLRSLKMQRNGISKLKDGAFFGLNNMEELELEHNNLTRVNKGWLYGLRMLQQLYVSQNAIERISPDAWEFCQRLSELDLSYNQLTRLDESAFVGLSLLERLNLGDNRVTHIADGVFRFLSNLQTLDLRNNEISWAIEDASEAFAGLTSLTKLILQGNQIKSITKKAFIGLESLEHLDLNNNAIMSIQENAFSQTHLKELILNTSSLLCDCHLKWLLQWLVDNNFQHSVNVSCAHPEWLAGQSILNVDLKDFVCDDFLKPQIRTHPETIIALRGMNVTLTCTAVSSSDSPMSTVWRKDSEILYDVDTENFVRYWQQAGEALEYTSILHLFNVNFTDEGKYQCIVTNHFGSNYSQKAKLTVNEMPSFLKTPMDLTIRTGAMARLECAAEGHPAPQISWQKDGGTDFPAARERRMHVMPEDDVFFIANVKIEDMGIYSCMAQNTAGGLSANASLTVLETPSFIRPLEDKTVTRGETAVLQCIAGGSPAPRLNWTKDDGPLLVTERHFFAAANQLLIIVDAGLEDAGKYTCIMSNTLGTERGHIYLNVISSPNCDSSQSSIGHEDDGWTTVGIVIIVVVCCVVGTSLIWVIVIYHMRRKNEDYSITNTEELNLPADIPSYLSSQGTLSEPQEGYSNSEAGSHQQLMPPANGYIHKGTDGGTGTRVICSDCYDNANIYSRTREYCPYTYIAEEDVLDQTLSSLMVQMPKETYLVHPPQDTTALESLIPSANREPSAFPTNHERISEKKLPSTQMSGETLQRPVWNINRELGLPHPPFSQQPVHESPQLHQNEGLAGREPDCSASSMSCHRLQDHAFDFSRTRNIQDGSEGT

SEQ ID NO: 51404 - protein, 291 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITVLREIHRFTNMS

SEQ ID NO: 51405 - protein, 557 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLLFTSNSFDVISDDAFIGLPHLEYLFIENNNIKSISRHTFRGLKSLIHLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 51406 - protein, 509 aa, Homo sapiens
MESERSKRMGNACIPLKRIAYFLCLLSALLLTEGKKPAKPKCPAVCTCTKDNALCENARSIPRTVPPDVISLSFVRSGFTEISEGSFLFTPSLQLLSLANNNLQTLPKDIFKGLDSLTNVDLRGNSFNCDCKLKWLVEWLGHTNATVEDIYCEGPPEYKKRKINSLSSKDFDCIITEFAKSQDLPYQSLSIDTFSYLNDEYVVIAQPFTGKCIFLEWDHVEKTFRNYDNITGTSTVVCKPIVIETQLYVIVAQLFGGSHIYKRDSFANKFIKIQDIEILKIRKPNDIETFKIENNWYFVVADSSKAGFTTIYKWNGNGFYSHQSLHAWYRDTDVEYLEIVRTPQTLRTPHLILSSSSQRPVIYQWNKATQLFTNQTDIPNMEDVYAVKHFSVKGDVYICLTRFIGDSKVMKWGGSSFQDIQRMPSRGSMVFQPLQINNYQYAILGSDYSFTQVYNWDAEKAKFVKFQELNVQAPRSFTHVSINKRNFLFASSFKGNTQIYKHVIVDLSA

SEQ ID NO: 51407 - protein, 840 aa, Homo sapiens
MAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 51408 - protein, 821 aa, Homo sapiens
MAGPGSTGGQIGAAALAGGARSKVAPSVDFDHSCSDSVEYLTLNFGPFETVHRWRRLPPCDEFVGARRSKHTVVAYKDAIYVFGGDNGAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 51409 - protein, 799 aa, Homo sapiens
MNYDPIVSKVAEVLASGRAIRKREVERSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNLFQFEFKDKTWTRIPTEHLLRGSPPPPQRRYGHTMVAFDRHLYVFGGAADNTLPNELHCYDVDFQTWEVVQPSSDSEVGGAEVPERACASEEVPTLTYEERVGFKKSRDVFGLDFGTTSAKQPTQPASELPSGRLFHAAAVISDAMYIFGGTVDNNIRSGEMYRFQFSCYPKCTLHEDYGRLWESRQFCDVEFVLGEKEECVQGHVAIVTARSRWLRRKITQARERLAQKLEQEAAPVPREAPGVAAGGARPPLLHVAIREAEARPFEVLMQFLYTDKIKYPRKGHVEDVLLIMDVYKLALSFQLCRLEQLCRQYIEASVDLQNVLVVCESAARLQLSQLKEHCLNFVVKESHFNQVIMMKEFERLSSPLIVEIVRRKQQPPPRTPLDQPVDIGTSLIQDMKAYLEGAGAEFCDITLLLDGHPRPAHKAILAARSSYFEAMFRSFMPEDGQVNISIGEMVPSRQAFESMLRYIYYGEVNMPPEDSLYLFAAPYYYGFYNNRLQAYCKQNLEMNVTVQNVLQILEAADKTQALDMKRHCLHIIVHQFTKVSKLPTLRSLSQQLLLDIIDSLASHISDKQCAELGADI

SEQ ID NO: 51410 - protein, 1025 aa, Homo sapiens
MEPFTNDRLQLPRNMIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 51411 - protein, 1011 aa, Homo sapiens
MIENSMFEEEPDVVDLAKEPCLHPLEPDEVEYEPRGSRLLVRGLGEHEMEEDEEDYESSAKLLGMSFMNRSSGLRNSATGYRQSPDGACSVPSARTMVVCAFVIVVAVSVIMVIYLLPRCTFTKEGCHKKNQSIGLIQPFATNGKLFPWAQIRLPTAVVPLRYELSLHPNLTSMTFRGSVTISVQALQVTWNIILHSTGHNISRVTFMSAVSSQEKQAEILEYAYHGQIAIVAPEALLAGHNYTLKIEYSANISSSYYGFYGFSYTDESNEKKYFAATQFEPLAARSAFPCFDEPAFKATFIIKIIRDEQYTALSNMPKKSSVVLDDGLVQDEFSESVKMSTYLVAFIVGEMKNLSQDVNGTLVSIYAVPEKIGQVHYALETTVKLLEFFQNYFEIQYPLKKLDLVAIPDFEAGAMENWGLLTFREETLLYDSNTSSMADRKLVTKIIAHELAHQWFGNLVTMKWWNDLWLNEGFATFMEYFSLEKIFKELSSYEDFLDARFKTMKKDSLNSSHPISSSVQSSEQIEEMFDSLSYFKGSSLLLMLKTYLSEDVFQHAVVLYLHNHSYASIQSDDLWDSFNEVTNQTLDVKRMMKTWTLQKGFPLVTVQKKGKELFIQQERFFLNMKPEIQPSDTSYLWHIPLSYVTEGRNYSKYQSVSLLDKKSGVINLTEEVLWVKVNINMNGYYIVHYADDDWEALIHQLKINPYVLSDKDRANLINNIFELAGLGKVPLKRAFDLINYLGNENHTAPITEALFQTDLIYNLLEKLGYMDLASRLVTRVFKLLQNQIQQQTWTDEGTPSMRELRSALLEFACTHNLGNCSTTAMKLFDDWMASNGTQSLPTDVMTTVFKVGAKTDKGWSFLLGKYISIGSEAEKNKILEALASSEDVRKLYWLMKSSLNGDNFRTQKLSFIIRTVGRHFPGHLLAWDFVKENWNKLVQKFPLGSYTIQNIVAGSTYLFSTKTHLSEVQAFFENQSEATFRLRCVQEALEVIQLNIQWMEKNLKSLTWWL

SEQ ID NO: 51412 - protein, 1149 aa, Homo sapiens
MAERKGTAKVDFLKKIEKEIQQKWDTERVFEVNASNLEKQTSKGKYFVTFPYPYMNGRLHLGHTFSLSKCEACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 51413 - protein, 159 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAKLDLLNTSGAL

SEQ ID NO: 51414 - protein, 1176 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 51415 - protein, 1122 aa, Homo sapiens
MNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 51416 - protein, 123 aa, Homo sapiens
MWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQTMKR

SEQ ID NO: 51417 - protein, 485 aa, Homo sapiens
MWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 51418 - protein, 1130 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQTGEGVGPQEYTLLKLKVLEPYPSKLSGLKGKNIFLVAATLRPETMFGQTNCWVRPDMKYIGFETVNGDIFICTQKAARNMSYQGFTKDNGVVPVVKELMGEEILGASLSAPLTSYKVIYVLPMLTIKEDKGTGVVTSVPSDSPDDIAALRDLKKKQALRAKYGIRDDMVLPFEPVPVIEIPGFGNLSAVTICDELKIQSQNDREKLAEAKEKIYLKGFYEGIMLVDGFKGQKVQDVKKTIQKKMIDAGDALIYMEPEKQVMSRSSDECVVALCDQWYLDYGEENWKKQTSQCLKNLETFCEETRRNFEATLGWLQEHACSRTYGLGTHLPWDEQWLIESLSDSTIYMAFYTVAHLLQGGNLHGQAESPLGIRPQQMTKEVWDYVFFKEAPFPKTQIAKEKLDQLKQEFEFWYPVDLRVSGKDLVPNHLSYYLYNHVAMWPEQSDKWPTAVRANGHLLLNSEKMSKSTGNFLTLTQAIDKFSADGMRLALADAGDTVEDANFVEAMADAGILRLYTWVEWVKEMVANWDSLRSGPASTFNDRVFASELNAGIIKTDQNYEKMMFKEALKTGFFEFQAAKDKYRELAVEGMHRELVFRFIEVQTLLLAPFCPHLCEHIWTLLGKPDSIMNASWPVAGPVNEVLIHSSQYLMEVTHDLRLRLKNYMMPAKGKKTDKQPLQKPSHCTIYVAKNYPPWQHTTLSVLRKHFEANNGKLPDNKVIASELGSMPELKKYMKKVMPFVAMIKENLEKMGPRILDLQLEFDEKAVLMENIVYLTNSLELEHIEVKFASEAEDKIREDCCPGKPLNVFRIEPGVSVSLVNPQPSNGHFSTKIEIRQGDNCDSIIRRLMKMNRGIKDLSKVKLMRFDDPLLGPRRVPVLGKEYTEKTPISEHAVFNVDLMSKKIHLTENGIRVDIGDTIIYLVH

SEQ ID NO: 51419 - protein, 903 aa, Homo sapiens
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 51420 - protein, 860 aa, Homo sapiens
MASVWQRLGFYASLLKRQLNGGPDVIKWERRVIPGCTRSIYSATGKWTKEYTLQTRKDVEKWWHQRIKEQASKISEADVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 51421 - protein, 903 aa, Homo sapiens; identical to SEQ ID NO: 51419

SEQ ID NO: 51422 - protein, 114 aa, Homo sapiens
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARF

SEQ ID NO: 51423 - protein, 202 aa, Homo sapiens
MKVLAAGVVPLLLVLHWKHGAGSPLPITPVNATCAIRHPCHNNLMNQIRSQLAQLNGSANALFILYYTAQGEPFPNNLDKLCGPNVTDFPPFHANGTEKAKLVELYRIVVYLGTSLGNITRDQKILNPSALSLHSKLNATADILRGLLSNVLCRLCSKYHVGHVDVTYGPDTSGKDVFQKKKLGCQLLGKYKQIIAVLAQAF

SEQ ID NO: 51424 - protein, 1097 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFTLNEQNVSLIPDTPEILNLSADFSTSTLYLKWNDRGSVFPHRSNVIWEIKVLRKESMELVKLVTHNTTLNGKDTLHHWSWASDMPLECAIHFVEIRCYIDNLHFSGLEEWSDWSPVKNISWIPDSQTKVFPQDKVILVGSDITFCCVSQEKVLSALIGHTNCPLIHLDGENVAIKIRNISVSASSGTNVVFTTEDNIFGTVIFAGYPPDTPQQLNCETHDLKEIICSWNPGRVTALVGPRATSYTLVESFSGKYVRLKRAEAPTNESYQLLFQMLPNQEIYNFTLNAHNPLGRSQSTILVNITEKVYPHTPTSFKVKDINSTAVKLSWHLPGNFAKINFLCEIEIKKSNSVQEQRNVTIKGVENSSYLVALDKLNPYTLYTFRIRCSTETFWKWSKWSNKKQHLTTEASPSKGPDTWREWSSDGKNLIIYWKPLPINEANGKILSYNVSCSSDEETQSLSEIPDPQHKAEIRLDKNDYIISVVAKNSVGSSPPSKIASMEIPNDDLKIEQVVGMGKGILLTWHYDPNMTCDYVIKWCNSSRSEPCLMDWRKVPSNSTETVIESDEFRPGIRYNFFLYGCRNQGYQLLRSMIGYIEELAPIVAPNFTVEDTSADSILVKWEDIPVEELRGFLRGYLFYFGKGERDTSKMRVLESGRSDIKVKNITDISQKTLRIADLQGKTSYHLVLRAYTDGGVGPEKSMYVVTKENSVGLIIAILIPVAVAVIVGVVTSILCYRKREWIKETFYPDIPNPENCKALQFQKSVCEGSSALKTLEMNPCTPNNVEVLETRSAFPKIEDTEIISPVAERPEDRSDAEPENHVVVSYCPPIIEEEIPNPAADEAGGTAQVIYIDVQSMYQPQAKPEEEQENDPVGGAGYKPQMHLPINSTVEDIAAEEDLDKTAGYRPQANVNTWNLVSPDSPRSIDSNSEIVSFGSPCSINSRQFLIPPKDEDSPKSNGGGWSFTNFFQNKPND

SEQ ID NO: 51425 - protein, 1097 aa, Homo sapiens; identical to SEQ ID NO: 51424

SEQ ID NO: 51426 - protein, 126 aa, Homo sapiens
MMDIYVCLKRPSWMVDNKRMRTASNFQWLLSTFILLYLMNQVNSQKKGAPHDLKCVTNNLQVWNCSWKAPSGTGRGTDYEVCIENRSRSCYQLEKTSIKIPALSHGDYEITINSLHDFGSSTSKFT

SEQ ID NO: 51427 - protein, 75 aa, Homo sapiens
MMDIYVCLKRPSWMVDNKRMRTASNFQWLLSTFILLYLMNQVNSQKKGAPHDLKCVTNNLQVWNCSWKAPSGTGR

SEQ ID NO: 51428 - protein, 151 aa, Homo sapiens
MFSTKALLLAGLISTALAGPWANICAGKSSNEIRTCDRHGCGQYSAQRSQRPHQGVDILCSAGSTVYAPFTGMIVGQEKPYQNKNAINNGVRISGRGFCVKMFYIKPIKYKGPIKKGEKLGTLLPLQKVYPGIQSHVHIENCDSSDPTAYL

SEQ ID NO: 51429 - protein, 375 aa, Homo sapiens
MTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 51430 - protein, 651 aa, Homo sapiens
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 51431 - protein, 651 aa, Homo sapiens
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 51432 - protein, 597 aa, Homo sapiens
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 51433 - protein, 632 aa, Homo sapiens
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 51434 - protein, 447 aa, Homo sapiens
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 51435 - protein, 491 aa, Homo sapiens
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 51436 - protein, 489 aa, Homo sapiens
MTPIVTVLICLRLSLGPRTHVQAGTLPKPTLWAEPGSVITQGSPVTLWCQGILETQEYRLYREKKTAPWITRIPQEIVKKGQFPIPSITWEHTGRYRCFYGSHTAGWSEPSDPLELVVTGAYIKPTLSALPSPVVTSGGNVTLHCVSQVAFGSFILCKEGEDEHPQCLNSQPRTHGWSRAIFSVGPVSPSRRWSYRCYAYDSNSPHVWSLPSDLLELLVLGVSKKPSLSVQPGPIVAPGESLTLQCVSDVSYDRFVLYKEGERDFLQLPGPQPQAGLSQANFTLGPVSRSYGGQYRCSGAYNLSSEWSAPSDPLDILIAGQFRGRPFISVHPGPTVASGENVTLLCQSWGPFHTFLLTKAGAADAPLRLRSIHEYPKYQAEFPMSPVTSAHSGTYRCYGSLSSNPYLLSHPSDSLELMVSGAAETLSPPQNKSDSKAGAANTLSPSQNKTASHPQDYTVENLIRMGIAGLVLVVLGILLFEAQHSQRSL

SEQ ID NO: 51437 - protein, 466 aa, Homo sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSASLGQHPQDYTVENLIRMGVAGLVLVVLGILLFEAQHSQRSLQDAAGR

SEQ ID NO: 51438 - protein, 483 aa, Homo sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLSVQPVPTVAPGKNVTLLCQSRGQFHTFLLTKEGAGHPPLHLRSEHQAQQNQAEFRMGPVTSAHVGTYRCYSSLSSNPYLLSLPSDPLELVVSEAAETLSPSQNKTDSTTTSLGQHPQDYTVENLIRMGVAGLVLVVLGILLFEAQHSQRSLQDAAGR

SEQ ID NO: 51439 - protein, 483 aa, Homo sapiens; identical to SEQ ID NO: 51438

SEQ ID NO: 51440 - protein, 327 aa, Homo sapiens
MTPILTVLICLGLSLGPRTHVQAGHLPKPTLWAEPGSVIIQGSPVTLRCQGSLQAEEYHLYRENKSASWVRRIQEPGKNGQFPIPSITWEHAGRYHCQYYSHNHSSEYSDPLELVVTGAYSKPTLSALPSPVVTLGGNVTLQCVSQVAFDGFILCKEGEDEHPQRLNSHSHARGWSWAIFSVGPVSPSRRWSYRCYAYDSNSPYVWSLPSDLLELLVPGVSKKPSLSVQPGPMVAPGESLTLQCVSDVGYDRFVLYKEGERDFLQRPGWQPQAGLSQANFTLGPVSPSHGGQYRCYSAHNLSSEWSAPSDPLDILITGQFYDRPSLS

SEQ ID NO: 51441 - protein, 439 aa, Homo sapiens
MTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 51442 - protein, 456 aa, Homo sapiens
MHRGLIHPQSSAVGGDAMTPILTVLICLGLSLDPRTHVQAGPLPKPTLWAEPGSVITQGSPVTLRCQGSLETQEYHLYREKKTALWITRIPQELVKKGQFPILSITWEHAGRYCCIYGSHTAGLSESSDPLELVVTGAYSKPTLSALPSPVVTSGGNVTIQCDSQVAFDGFILCKEGEDEHPQCLNSHSHARGSSRAIFSVGPVSPSRRWSYRCYGYDSRAPYVWSLPSDLLGLLVPGVSKKPSLSVQPGPVVAPGEKLTFQCGSDAGYDRFVLYKEWGRDFLQRPGRQPQAGLSQANFTLGPVSRSYGGQYTCSGAYNLSSEWSAPSDPLDILITGQIRARPFLSVRPGPTVASGENVTLLCQSQGGMHTFLLTKEGAADSPLRLKSKRQSHKYQAEFPMSPVTSAHAGTYRCYGSLSSNPYLLTHPSDPLELVVSGAAETLSPPQNKSDSKAGE

SEQ ID NO: 51443 - protein, 652 aa, Homo sapiens
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRQSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 51444 - protein, 650 aa, Homo sapiens
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 51445 - protein, 650 aa, Homo sapiens; identical to SEQ ID NO: 51444

SEQ ID NO: 51446 - protein, 634 aa, Homo sapiens
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSAGPEDQPLTPTGSDPQSGLGRHLGVVIGILVAVILLLLLLLLLFLILRHRRQGKHWTSTQRKADFQHPAGAVGPEPTDRGLQWRSSPAADAQEENLYAAVKHTQPEDGVEMDTRSPHDEDPQAVTYAEVKHSRPRREMASPPSPLSGEFLDTKDRQAEEDRQMDTEAAASEAPQDVTYAQLHSLTLRREATEPPPSQEGPSPAVPSIYATLAIH

SEQ ID NO: 51447 - protein, 650 aa, Homo sapiens; identical to SEQ ID NO: 51444

SEQ ID NO: 51448 - protein, 510 aa, Homo sapiens
MTPILTVLICLGLSLGPRTHVQAGHLPKPTLWAEPGSVITQGSPVTLRCQGGQETQEYRLYREKKTALWITRIPQELVKKGQFPIPSITWEHAGRYRCYYGSDTAGRSESSDPLELVVTGAYIKPTLSAQPSPVVNSGGNVILQCDSQVAFDGFSLCKEGEDEHPQCLNSQPHARGSSRAIFSVGPVSPSRRWWYRCYAYDSNSPYEWSLPSDLLELLVLGVSKKPSLSVQPGPIVAPEETLTLQCGSDAGYNRFVLYKDGERDFLQLAGAQPQAGLSQANFTLGPVSRSYGGQYRCYGAHNLSSEWSAPSDPLDILIAGQFYDRVSLSVQPGPTVASGENVTLLCQSQGWMQTFLLTKEGAADDPWRLRSTYQSQKYQAEFPMGPVTSAHAGTYRCYGSQSSKPYLLTHPSDPLELVVSGPSGGPSSPTTGPTSTSGPEDQPLTPTGSDPQSGLGRHLGVVIGILVAVILLLLLLLLLFLILRHRRQGKHWTSSPAQLPMPRKKTSMLP

SEQ ID NO: 51449 - protein, 598 aa, Homo sapiens
MTPIVTVLICLGLSLGPRTHVQTGTIPKPTLWAEPDSVITQGSPVTLSCQGSLEAQEYRLYREKKSASWITRIRPELVKNGQFHIPSITWEHTGRYGCQYYSRARWSELSDPLVLVMTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 51450 - protein, 482 aa, Homo sapiens
MTGAYPKPTLSAQPSPVVTSGGRVTLQCESQVAFGGFILCKEGEEEHPQCLNSQPHARGSSRAIFSVGPVSPNRRWSHRCYGYDLNSPYVWSSPSDLLELLVPGVSKKPSLSVQPGPVVAPGESLTLQCVSDVGYDRFVLYKEGERDLRQLPGRQPQAGLSQANFTLGPVSRSYGGQYRCYGAHNLSSECSAPSDPLDILITGQIRGTPFISVQPGPTVASGENVTLLCQSWRQFHTFLLTKAGAADAPLRLRSIHEYPKYQAEFPMSPVTSAHAGTYRCYGSLNSDPYLLSHPSEPLELVVSGPSMGSSPPPTGPISTPAGPEDQPLTPTGSDPQSGLGRHLGVVIGILVAVVLLLLLLLLLFLILRHRRQGKHWTSTQRKADFQHPAGAVGPEPTDRGLQWRSSPAADAQEENLYAAVKDTQPEDGVEMDTRAAASEAPQDVTYAQLHSLTLRRKATEPPPSQEREPPAEPSIYATLAIH

SEQ ID NO: 51451 - protein, 643 aa, Homo sapiens
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGPEDQPLNPPGSGPQNPPGLGSGAGTRAAGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 51452 - protein, 631 aa, Homo sapiens
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 51453 - protein, 648 aa, Homo sapiens
MTPALTALLCLGLSLGPRTRVQAGPFPKPTLWAEPGSVISWGSPVTIWCQGSLEAQEYQLDKEGSPEPLDRNNPLEPKNKARFSIPSMTQHHAGRYRCHYYSSAGWSEPSDPLELVMTGAYSKPTLSALPSPVVASGGNMTLRCGSQKGYHHFVLMKEGEHQLPRTLDSQQLHSRGFQALFPVGPVTPSHRWRFTCYYYYTNTPWVWSHPSDPLEILPSGVSRKPSLLTLQGPVLAPGQSLTLQCGSDVGYNRFVLYKEGERDFLQRPGQQPQAGLSQANFTLGPVSPSNGGQYRCYGAHNLSSEWSAPSDPLNILMAGQIYDTVSLSAQPGPTVASGENVTLLCQSWWQFDTFLLTKEGAAHPPLRLRSMYGAHKYQAEFPMSPVTSAHAGTYRCYGSYSSNPHLLSHPSEPLELVVSGHSGGSSLPPTGPPSTPGGPEDQPLNPPGSGPQNRLGRYLEVLIGVSVAFVLLLFLLLFLLLRRQRHSKHRTSDQRKTDFQRPAGAAETEPKDRGLLRRSSPAADVQEENLYAAVKDTQSEDRVELDSQSPHDEDPQAVTYAPVKHSSPRREMASPPSSLSGEFLDTKDRQVEEDRQMDTEAAASEASQDVTYAQLHSLTLRRKATEPPPSQEGEPPAEPSIYATLAIH

SEQ ID NO: 51454 - protein, 631 aa, Homo sapiens; identical to SEQ ID NO: 51452

SEQ ID NO: 51455 - protein, 158 aa, Homo sapiens
MTPALTALLCLGLSLGPRTRVQAGPFPKPTLWAEPGSVISWGSPVTIWCQGSQEAQEYRLHKEGSPEPLDRNNPLEPKNKARFSIPSMTEHHAGRYRCHYYSSAGWSEPSDPLEMVMTGAYSKPTLSALPSPVVASGGNMTLRCGSQKGYHHFVLMKE

SEQ ID NO: 51456 - protein, 448 aa, Homo sapiens
MIPTFTALLCLGLSLGPRTHMQAGPLPKPTLWAEPGSVISWGNSVTIWCQGTLEAREYRLDKEESPAPWDRQNPLEPKNKARFSIPSMTEDYAGRYRCYYRSPVGWSQPSDPLELVMTGAYSKPTLSALPSPLVTSGKSVTLLCQSRSPMDTFLLIKERAAHPLLHLRSEHGAQQHQAEFPMSPVTSVHGGTYRCFSSHGFSHYLLSHPSDPLELIVSGSLEDPRPSPTRSVSTAAGPEDQPLMPTGSVPHSGLRRHWEVLIGVLVVSILLLSLLLFLLLQHWRQGKHRTLAQRQADFQRPPGAAEPEPKDGGLQRRSSPAADVQGENFCAAVKNTQPEDGVEMDTRQSPHDEDPQAVTYAKVKHSRPRREMASPPSPLSGEFLDTKDRQAEEDRQMDTEAAASEAPQDVTYAQLHSFTLRQKATEPPPSQEGASPAEPSVYATLAIH

SEQ ID NO: 51457 - protein, 448 aa, Homo sapiens; identical to SEQ ID NO: 51456

SEQ ID NO: 51458 - protein, 590 aa, Homo sapiens
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 51459 - protein, 591 aa, Homo sapiens
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATGFYAEPTLLALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARAAASEAPQDVTYAQLHSLTLRREATEPPPSQEREPPAEPSIYAPLAIH

SEQ ID NO: 51460 - protein, 622 aa, Homo sapiens
MTLTLSVLICLGLSVGPRTCVQAGTLPKPTLWAEPASVIARGKPVTLWCQGPLETEEYRLDKEGLPWARKRQNPLEPGAKAKFHIPSTVYDSAGRYRCYYETPAGWSEPSDPLELVATALPSPVVASGGNVTLQCDTLDGLLTFVLVEEEQKLPRTLYSQKLPKGPSQALFPVGPVTPSCRWRFRCYYYYRKNPQVWSNPSDLLEILVPGVSRKPSLLIPQGSVVARGGSLTLQCRSDVGYDIFVLYKEGEHDLVQGSGQQPQAGLSQANFTLGPVSRSHGGQYRCYGAHNLSPRWSAPSDPLDILIAGLIPDIPALSVQPGPKVASGENVTLLCQSWHQIDTFFLTKEGAAHPPLCLKSKYQSYRHQAEFSMSPVTSAQGGTYRCYSAIRSYPYLLSSPSYPQELVVSGPSGDPSLSPTGSTPTPAGPEDQPLTPTGLDPQSGLGRHLGVVTGVSVAFVLLLFLLLFLLLRHRHQSKHRTSAHFYRPAGAAGPEPKDQGLQKRASPVADIQEEILNAAVKDTQPKDGVEMDARQSPHDEDPQAVTYAEVKHSRPRREMASPPSPLSGEFLDTKDRQAEEDRQMDTERVLSSPGPQASPPPPRSLPLTLPRCRLLHLKPPRM

SEQ ID NO: 51461 - protein, 864 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 51462 - protein, 803 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILVKQKKWQGLQEMRLPSPELELSKLRTSAIRTAPNPYYCQVGLGPAQSWPLPPGVTEVSPANVTLLRALGHGAFGEVYEGLVIGLPGDSSPLQVAIKTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 51463 - protein, 478 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGGGGWTSRAPSPQAGRSLQEGAEGGQGCSEAWATLGWAAAGGFGGGGGACTAGGGGGGYRGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGTKRLAGTVDSRLLLSSELGWVSAGGGRRR

SEQ ID NO: 51464 - protein, 734 aa, Homo sapiens
MGCWGQLLVWFGAAGAILCSSPGSQETFLRSSPLPLASPSPRDPKVSAPPSILEPASPLNSPGTEGSWLFSTCGASGRHGPTQTQCDGAYAGTSVVVTVGAAGQLRGVQLWRVPGPGQYLISAYGAAGGKGAKNHLSRAHGVFVSAIFSLGLGESLYILVGQQGEDACPGGSPESQLVCLGESRAVEEHAAMDGSEGVPGSRRWAGGGGGGGGATYVFRVRAGELEPLLVAAGGGGRAYLRPRDRGRTQASPEKLENRSEAPGSGGRGGAAGGDASETDNLWADGEDGVSFIHPSSELFLQPLAVTENHGEVEIRRHLNCSHCPLRDCQWQAELQLAECLCPEGMELAVDNVTCMDLHKPPGPLVLMVAVVATSTLSLLMVCGVLILGGAWPGPVLASATRCHRGFPSQCYSAQTLPELCSPQDELDFLMEALIISKFRHQNIVRCVGLSLRATPRLILLELMSGGDMKSFLRHSRPHLGQPSPLVMRDLLQLAQDIAQGCHYLEENHFIHRDIAARNCLLSCAGPSRVAKIGDFGMARDIYRASYYRRGDRALLPVKWMPPEAFLEGIFTSKTDSWSFGVLLWEIFSLGYMPYPGRTNQEVLDFVVGGGRMDPPRGCPGPVYRIMTQCWQHEPELRPSFASILERLQYCTQDPDVLNSLLPMELGPTPEEEGTSGLGNRSLECLRPPQPQELSPEKLKSWGGSPLGPWLSSGLKPLKSRGLQPQNLWNPTYRS

SEQ ID NO: 51465 - protein, 59 aa, Homo sapiens
MLSRNDDICIYGGLGLGGLLLLAVVLLSACLCWLHRRGPGLLRAGTPLCISAEAASAQQ

SEQ ID NO: 51466 - protein, 66 aa, Homo sapiens
MLSRNDDICIYGGLGLGGLLLLAVVLLSACLCWLHRRAPSVLVPGPGLLRAGTPLCISAEAASAQQ

SEQ ID NO: 51467 - protein, 73 aa, Homo sapiens
MLSRNDVKRLERSWHLLSWSQAQGSSEQELHYASLQRLPVPSSEGPDLRGRDKRGTKEDPRADYACIAENKPT

SEQ ID NO: 51468 - protein, 66 aa, Homo sapiens
MLSRNDVKRLERSWAQGSSEQELHYASLQRLPVPSSEGPDLRGRDKRGTKEDPRADYACIAENKPT

SEQ ID NO: 51469 - protein, 35 aa, Homo sapiens
MLSRNDAPSVLVPGPGLLRAGTPLCISAEAASAQQ

SEQ ID NO: 51470 - protein, 104 aa, Homo sapiens
MLSRNDDICIYGGLGLGGLLLLAVVLLSACLCWLHRRVKRLERSWHLLSWSQAQGSSEQELHYASLQRLPVPSSEGPDLRGRDKRGTKEDPRADYACIAENKPT

SEQ ID NO: 51471 - protein, 13 aa, Homo sapiens
MLSRNDEAASAQQ

SEQ ID NO: 51472 - protein, 35 aa, Homo sapiens; identical to SEQ ID NO: 51469

SEQ ID NO: 51473 - protein, 91 aa, Homo sapiens
MIYVSTGAWGWAGSCFWQWSFCPPACVGCIEEHLLSWSQAQGSSEQELHYASLQRLPVPSSEGPDLRGRDKRGTKEDPRADYACIAENKPT

SEQ ID NO: 51474 - protein, 51 aa, Homo sapiens
MLSRNDVKRLERSWRLPVPSSEGPDLRGRDKRGTKEDPRADYACIAENKPT

SEQ ID NO: 51475 - protein, 63 aa, Homo sapiens
MHLCRGCQCPAVRDLTSGAETREAPRRIQELTMPALLRTNPPEHPRHLPQPRRVDRVPLWSSQ

SEQ ID NO: 51476 - protein, 73 aa, Homo sapiens; identical to SEQ ID NO: 51467

SEQ ID NO: 51477 - protein, 35 aa, Homo sapiens; identical to SEQ ID NO: 51469

SEQ ID NO: 51478 - protein, 66 aa, Homo sapiens; identical to SEQ ID NO: 51466

SEQ ID NO: 51479 - protein, 104 aa, Homo sapiens; identical to SEQ ID NO: 51470

SEQ ID NO: 51480 - protein, 44 aa, Homo sapiens
MLSRNDDICIYGGLGLGGLLLLAVVLLSACLCWLHRREAASAQQ

SEQ ID NO: 51481 - protein, 66 aa, Homo sapiens
MLSRNDDICIYGGLGLGGLLLLAVVLLSACLCWLHRRVKRLERSWRLPVPSSEGPDLRGRDKRGTK

SEQ ID NO: 51482 - protein, 66 aa, Homo sapiens; identical to SEQ ID NO: 51468

SEQ ID NO: 51483 - protein, 97 aa, Homo sapiens
MLSRNDDICIYGGLGLGGLLLLAVVLLSACLCWLHRRVKRLERSWAQGSSEQELHYASLQRLPVPSSEGPDLRGRDKRGTKEDPRADYACIAENKPT

SEQ ID NO: 51484 - protein, 59 aa, Homo sapiens; identical to SEQ ID NO: 51465

SEQ ID NO: 51485 - protein, 28 aa, Homo sapiens
MLSRNDGPGLLRAGTPLCISAEAASAQQ

SEQ ID NO: 51486 - protein, 28 aa, Homo sapiens
MLSRNDGPGLLRAGTPLCISAEAASAQQ

SEQ ID NO: 51487 - protein, 28 aa, Homo sapiens
MLSRNDGPGLLRAGTPLCISAEAASAQQ

SEQ ID NO: 51488 - protein, 28 aa, Homo sapiens
MLSRNDGPGLLRAGTPLCISAEAASAQQ

SEQ ID NO: 51489 - protein, 13 aa, Homo sapiens
MLSRNDEAASAQQ

SEQ ID NO: 51490 - protein, 82 aa, Homo sapiens
MLSRNDDICIYGGLGLGGLLLLAVVLLSACLCWLHRRVKRLERSWRLPVPSSEGPDLRGRDKRGTKEDPRADYACIAENKPT

SEQ ID NO: 51491 - protein, 66 aa, Homo sapiens; identical to SEQ ID NO: 51468

SEQ ID NO: 51492 - protein, 66 aa, Homo sapiens; identical to SEQ ID NO: 51468

SEQ ID NO: 51493 - protein, 97 aa, Homo sapiens; identical to SEQ ID NO: 51483

SEQ ID NO: 51494 - protein, 51 aa, Homo sapiens; identical to SEQ ID NO: 51474

SEQ ID NO: 51495 - protein, 97 aa, Homo sapiens; identical to SEQ ID NO: 51483

SEQ ID NO: 51496 - protein, 104 aa, Homo sapiens; identical to SEQ ID NO: 51470

SEQ ID NO: 51497 - protein, 43 aa, Homo sapiens
YRGMMIYVSTGAWGWAGSCFWQWSFCPPACVGCIEERLPVPSS

SEQ ID NO: 51498 - protein, 36 aa, Homo sapiens
MLSRNDDICIYGGLGLGGLLLLAVVLLSACLCWLHR

SEQ ID NO: 51499 - protein, 104 aa, Homo sapiens; identical to SEQ ID NO: 51470

SEQ ID NO: 51500 - protein, 46 aa, Homo sapiens
MLSRNDDICIYGGLGLGGLLLLAVVLLSACLCWLHRREHCLALEPL

SEQ ID NO: 51501 - protein, 13 aa, Homo sapiens
MLSRNDEAASAQQ

SEQ ID NO: 51502 - protein, 28 aa, Homo sapiens
MLSRNDGPGLLRAGTPLCISAEAASAQQ

SEQ ID NO: 51503 - protein, 66 aa, Homo sapiens; identical to SEQ ID NO: 51468

SEQ ID NO: 51504 - protein, 28 aa, Homo sapiens
MLSRNDGPGLLRAGTPLCISAEAASAQQ

SEQ ID NO: 51505 - protein, 28 aa, Homo sapiens
MLSRNDGPGLLRAGTPLCISAEAASAQQ

SEQ ID NO: 51506 - protein, 43 aa, Homo sapiens
  MOD_RES (1)..(1): Any amino acid
XSRNDDICIYGGLGLGGLLLLAVVLLSACLCWLHRREAASAQQ

SEQ ID NO: 51507 - protein, 51 aa, Homo sapiens; identical to SEQ ID NO: 51474

SEQ ID NO: 51508 - protein, 35 aa, Homo sapiens; identical to SEQ ID NO: 51469

SEQ ID NO: 51509 - protein, 13 aa, Homo sapiens
MLSRNDEAASAQQ

SEQ ID NO: 51510 - protein, 97 aa, Homo sapiens; identical to SEQ ID NO: 51483

SEQ ID NO: 51511 - protein, 66 aa, Homo sapiens; identical to SEQ ID NO: 51468

SEQ ID NO: 51512 - protein, 46 aa, Homo sapiens; identical to SEQ ID NO: 51500

SEQ ID NO: 51513 - protein, 43 aa, Homo sapiens; identical to SEQ ID NO: 51506
  MOD_RES (1)..(1): Any amino acid

SEQ ID NO: 51514 - protein, 46 aa, Homo sapiens; identical to SEQ ID NO: 51500

SEQ ID NO: 51515 - protein, 28 aa, Homo sapiens
MLSRNDGPGLLRAGTPLCISAEAASAQQ

SEQ ID NO: 51516 - protein, 43 aa, Homo sapiens; identical to SEQ ID NO: 51506
  MOD_RES (1)..(1): Any amino acid

SEQ ID NO: 51517 - protein, 66 aa, Homo sapiens; identical to SEQ ID NO: 51468

SEQ ID NO: 51518 - protein, 59 aa, Homo sapiens; identical to SEQ ID NO: 51465

SEQ ID NO: 51519 - protein, 73 aa, Homo sapiens; identical to SEQ ID NO: 51467

SEQ ID NO: 51520 - protein, 66 aa, Homo sapiens; identical to SEQ ID NO: 51466

SEQ ID NO: 51521 - protein, 66 aa, Homo sapiens; identical to SEQ ID NO: 51468

SEQ ID NO: 51522 - protein, 28 aa, Homo sapiens
MLSRNDGPGLLRAGTPLCISAEAASAQQ

SEQ ID NO: 51523 - protein, 82 aa, Homo sapiens; identical to SEQ ID NO: 51490

SEQ ID NO: 51524 - protein, 51 aa, Homo sapiens; identical to SEQ ID NO: 51474

SEQ ID NO: 51525 - protein, 59 aa, Homo sapiens; identical to SEQ ID NO: 51465

SEQ ID NO: 51526 - protein, 66 aa, Homo sapiens; identical to SEQ ID NO: 51468

SEQ ID NO: 51527 - protein, 51 aa, Homo sapiens; identical to SEQ ID NO: 51474

SEQ ID NO: 51528 - protein, 82 aa, Homo sapiens; identical to SEQ ID NO: 51490

SEQ ID NO: 51529 - protein, 46 aa, Homo sapiens; identical to SEQ ID NO: 51500

SEQ ID NO: 51530 - protein, 35 aa, Homo sapiens; identical to SEQ ID NO: 51469

SEQ ID NO: 51531 - protein, 82 aa, Homo sapiens; identical to SEQ ID NO: 51490

SEQ ID NO: 51532 - protein, 28 aa, Homo sapiens
MLSRNDGPGLLRAGTPLCISAEAASAQQ

SEQ ID NO: 51533 - protein, 97 aa, Homo sapiens; identical to SEQ ID NO: 51483

SEQ ID NO: 51534 - protein, 28 aa, Homo sapiens
MLSRNDGPGLLRAGTPLCISAEAASAQQ

SEQ ID NO: 51535 - protein, 35 aa, Homo sapiens; identical to SEQ ID NO: 51469

SEQ ID NO: 51536 - protein, 97 aa, Homo sapiens; identical to SEQ ID NO: 51483

SEQ ID NO: 51537 - protein, 66 aa, Homo sapiens; identical to SEQ ID NO: 51468

SEQ ID NO: 51538 - protein, 66 aa, Homo sapiens; identical to SEQ ID NO: 51468

SEQ ID NO: 51539 - protein, 13 aa, Homo sapiens
MLSRNDEAASAQQ

SEQ ID NO: 51540 - protein, 28 aa, Homo sapiens
MLSRNDGPGLLRAGTPLCISAEAASAQQ

SEQ ID NO: 51541 - protein, 36 aa, Homo sapiens; identical to SEQ ID NO: 51498

SEQ ID NO: 51542 - protein, 97 aa, Homo sapiens; identical to SEQ ID NO: 51483

SEQ ID NO: 51543 - protein, 59 aa, Homo sapiens; identical to SEQ ID NO: 51465

SEQ ID NO: 51544 - protein, 97 aa, Homo sapiens; identical to SEQ ID NO: 51483

SEQ ID NO: 51545 - protein, 66 aa, Homo sapiens; identical to SEQ ID NO: 51466

SEQ ID NO: 51546 - protein, 28 aa, Homo sapiens
MLSRNDGPGLLRAGTPLCISAEAASAQQ

SEQ ID NO: 51547 - protein, 59 aa, Homo sapiens; identical to SEQ ID NO: 51465

SEQ ID NO: 51548 - protein, 66 aa, Homo sapiens; identical to SEQ ID NO: 51468

SEQ ID NO: 51549 - protein, 35 aa, Homo sapiens; identical to SEQ ID NO: 51469

SEQ ID NO: 51550 - protein, 66 aa, Homo sapiens; identical to SEQ ID NO: 51468

SEQ ID NO: 51551 - protein, 28 aa, Homo sapiens
MLSRNDGPGLLRAGTPLCISAEAASAQQ

SEQ ID NO: 51552 - protein, 35 aa, Homo sapiens; identical to SEQ ID NO: 51469

SEQ ID NO: 51553 - protein, 43 aa, Homo sapiens; identical to SEQ ID NO: 51506
  MOD_RES (1)..(1): Any amino acid

SEQ ID NO: 51554 - protein, 36 aa, Homo sapiens; identical to SEQ ID NO: 51498

SEQ ID NO: 51555 - protein, 36 aa, Homo sapiens; identical to SEQ ID NO: 51498

SEQ ID NO: 51556 - protein, 66 aa, Homo sapiens; identical to SEQ ID NO: 51468

SEQ ID NO: 51557 - protein, 97 aa, Homo sapiens; identical to SEQ ID NO: 51483

SEQ ID NO: 51558 - protein, 28 aa, Homo sapiens
MLSRNDGPGLLRAGTPLCISAEAASAQQ

SEQ ID NO: 51559 - protein, 104 aa, Homo sapiens; identical to SEQ ID NO: 51470

SEQ ID NO: 51560 - protein, 66 aa, Homo sapiens; identical to SEQ ID NO: 51468

SEQ ID NO: 51561 - protein, 36 aa, Homo sapiens; identical to SEQ ID NO: 51498

SEQ ID NO: 51562 - protein, 97 aa, Homo sapiens; identical to SEQ ID NO: 51483

SEQ ID NO: 51563 - protein, 51 aa, Homo sapiens; identical to SEQ ID NO: 51474

SEQ ID NO: 51564 - protein, 104 aa, Homo sapiens; identical to SEQ ID NO: 51470

SEQ ID NO: 51565 - protein, 97 aa, Homo sapiens; identical to SEQ ID NO: 51483

SEQ ID NO: 51566 - protein, 104 aa, Homo sapiens; identical to SEQ ID NO: 51470

SEQ ID NO: 51567 - protein, 51 aa, Homo sapiens; identical to SEQ ID NO: 51474

SEQ ID NO: 51568 - protein, 66 aa, Homo sapiens; identical to SEQ ID NO: 51466

SEQ ID NO: 51569 - protein, 36 aa, Homo sapiens; identical to SEQ ID NO: 51498

SEQ ID NO: 51570 - protein, 73 aa, Homo sapiens; identical to SEQ ID NO: 51467

SEQ ID NO: 51571 - protein, 66 aa, Homo sapiens; identical to SEQ ID NO: 51468

SEQ ID NO: 51572 - protein, 66 aa, Homo sapiens; identical to SEQ ID NO: 51468

SEQ ID NO: 51573 - protein, 35 aa, Homo sapiens; identical to SEQ ID NO: 51469

SEQ ID NO: 51574 - protein, 28 aa, Homo sapiens
MLSRNDGPGLLRAGTPLCISAEAASAQQ

SEQ ID NO: 51575 - protein, 46 aa, Homo sapiens; identical to SEQ ID NO: 51500

SEQ ID NO: 51576 - protein, 46 aa, Homo sapiens; identical to SEQ ID NO: 51500

SEQ ID NO: 51577 - protein, 66 aa, Homo sapiens; identical to SEQ ID NO: 51466

SEQ ID NO: 51578 - protein, 46 aa, Homo sapiens; identical to SEQ ID NO: 51500

SEQ ID NO: 51579 - protein, 28 aa, Homo sapiens
MLSRNDGPGLLRAGTPLCISAEAASAQQ

SEQ ID NO: 51580 - protein, 97 aa, Homo sapiens; identical to SEQ ID NO: 51483

SEQ ID NO: 51581 - protein, 59 aa, Homo sapiens; identical to SEQ ID NO: 51465

SEQ ID NO: 51582 - protein, 97 aa, Homo sapiens; identical to SEQ ID NO: 51483

SEQ ID NO: 51583 - protein, 28 aa, Homo sapiens
MLSRNDGPGLLRAGTPLCISAEAASAQQ

SEQ ID NO: 51584 - protein, 36 aa, Homo sapiens; identical to SEQ ID NO: 51498

SEQ ID NO: 51585 - protein, 51 aa, Homo sapiens; identical to SEQ ID NO: 51474

SEQ ID NO: 51586 - protein, 13 aa, Homo sapiens
MLSRNDEAASAQQ

SEQ ID NO: 51587 - protein, 66 aa, Homo sapiens; identical to SEQ ID NO: 51468

SEQ ID NO: 51588 - protein, 28 aa, Homo sapiens
MLSRNDGPGLLRAGTPLCISAEAASAQQ

SEQ ID NO: 51589 - protein, 104 aa, Homo sapiens; identical to SEQ ID NO: 51470

SEQ ID NO: 51590 - protein, 82 aa, Homo sapiens; identical to SEQ ID NO: 51490

SEQ ID NO: 51591 - protein, 66 aa, Homo sapiens; identical to SEQ ID NO: 51468

SEQ ID NO: 51592 - protein, 28 aa, Homo sapiens
MLSRNDGPGLLRAGTPLCISAEAASAQQ

SEQ ID NO: 51593 - protein, 43 aa, Homo sapiens; identical to SEQ ID NO: 51506
  MOD_RES (1)..(1): Any amino acid

SEQ ID NO: 51594 - protein, 82 aa, Homo sapiens; identical to SEQ ID NO: 51490

SEQ ID NO: 51595 - protein, 66 aa, Homo sapiens; identical to SEQ ID NO: 51468

SEQ ID NO: 51596 - protein, 59 aa, Homo sapiens; identical to SEQ ID NO: 51465

SEQ ID NO: 51597 - protein, 28 aa, Homo sapiens
MLSRNDGPGLLRAGTPLCISAEAASAQQ

SEQ ID NO: 51598 - protein, 82 aa, Homo sapiens; identical to SEQ ID NO: 51490

SEQ ID NO: 51599 - protein, 36 aa, Homo sapiens; identical to SEQ ID NO: 51498

SEQ ID NO: 51600 - protein, 73 aa, Homo sapiens; identical to SEQ ID NO: 51467

SEQ ID NO: 51601 - protein, 66 aa, Homo sapiens; identical to SEQ ID NO: 51468

SEQ ID NO: 51602 - protein, 28 aa, Homo sapiens
MLSRNDGPGLLRAGTPLCISAEAASAQQ

SEQ ID NO: 51603 - protein, 66 aa, Homo sapiens; identical to SEQ ID NO: 51466

SEQ ID NO: 51604 - protein, 73 aa, Homo sapiens; identical to SEQ ID NO: 51467

SEQ ID NO: 51605 - protein, 66 aa, Homo sapiens; identical to SEQ ID NO: 51466

SEQ ID NO: 51606 - protein, 28 aa, Homo sapiens
MLSRNDGPGLLRAGTPLCISAEAASAQQ

SEQ ID NO: 51607 - protein, 28 aa, Homo sapiens
MLSRNDGPGLLRAGTPLCISAEAASAQQ

SEQ ID NO: 51608 - protein, 28 aa, Homo sapiens
MLSRNDGPGLLRAGTPLCISAEAASAQQ

SEQ ID NO: 51609 - protein, 28 aa, Homo sapiens
MLSRNDGPGLLRAGTPLCISAEAASAQQ

SEQ ID NO: 51610 - protein, 97 aa, Homo sapiens; identical to SEQ ID NO: 51483

SEQ ID NO: 51611 - protein, 73 aa, Homo sapiens; identical to SEQ ID NO: 51467

SEQ ID NO: 51612 - protein, 28 aa, Homo sapiens
MLSRNDGPGLLRAGTPLCISAEAASAQQ

SEQ ID NO: 51613 - protein, 97 aa, Homo sapiens; identical to SEQ ID NO: 51483

SEQ ID NO: 51614 - protein, 66 aa, Homo sapiens; identical to SEQ ID NO: 51468

SEQ ID NO: 51615 - protein, 28 aa, Homo sapiens
MLSRNDGPGLLRAGTPLCISAEAASAQQ

SEQ ID NO: 51616 - protein, 66 aa, Homo sapiens; identical to SEQ ID NO: 51468

SEQ ID NO: 51617 - protein, 13 aa, Homo sapiens
MLSRNDEAASAQQ

SEQ ID NO: 51618 - protein, 43 aa, Homo sapiens; identical to SEQ ID NO: 51497

SEQ ID NO: 51619 - protein, 66 aa, Homo sapiens; identical to SEQ ID NO: 51468

SEQ ID NO: 51620 - protein, 97 aa, Homo sapiens; identical to SEQ ID NO: 51483

SEQ ID NO: 51621 - protein, 73 aa, Homo sapiens; identical to SEQ ID NO: 51467

SEQ ID NO: 51622 - protein, 13 aa, Homo sapiens
MLSRNDEAASAQQ

SEQ ID NO: 51623 - protein, 91 aa, Homo sapiens; identical to SEQ ID NO: 51473

SEQ ID NO: 51624 - protein, 91 aa, Homo sapiens; identical to SEQ ID NO: 51473

SEQ ID NO: 51625 - protein, 91 aa, Homo sapiens; identical to SEQ ID NO: 51473

SEQ ID NO: 51626 - protein, 35 aa, Homo sapiens; identical to SEQ ID NO: 51469

SEQ ID NO: 51627 - protein, 91 aa, Homo sapiens; identical to SEQ ID NO: 51473

SEQ ID NO: 51628 - protein, 35 aa, Homo sapiens; identical to SEQ ID NO: 51469

SEQ ID NO: 51629 - protein, 35 aa, Homo sapiens; identical to SEQ ID NO: 51469

SEQ ID NO: 51630 - protein, 91 aa, Homo sapiens; identical to SEQ ID NO: 51473

SEQ ID NO: 51631 - protein, 91 aa, Homo sapiens; identical to SEQ ID NO: 51473

SEQ ID NO: 51632 - protein, 35 aa, Homo sapiens; identical to SEQ ID NO: 51469

SEQ ID NO: 51633 - protein, 35 aa, Homo sapiens; identical to SEQ ID NO: 51469

SEQ ID NO: 51634 - protein, 35 aa, Homo sapiens; identical to SEQ ID NO: 51469

SEQ ID NO: 51635 - protein, 35 aa, Homo sapiens; identical to SEQ ID NO: 51469

SEQ ID NO: 51636 - protein, 91 aa, Homo sapiens; identical to SEQ ID NO: 51473

SEQ ID NO: 51637 - protein, 280 aa, Homo sapiens
MEREMVLCLAQTIHTQEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 51638 - protein, 270 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 51639 - protein, 287 aa, Homo sapiens
MSPHPTALLGLVLCLAQTIHTQEEDLPRPSISAEPGTVIPLGSHVTFVCRGPVGVQTFRLERESRSTYNDTEDVSQASPSESEARFRIDSVSEGNAGPYRCIYYKPPKWSEQSDYLELLVKETSGGPDSPDTEPGSSAGPTQRPSDNSHNEHAPASQGLKAEHLYILIGVSVVFLFCLLLLVLFCLHRQNQIKQGPPRSKDEEQKPQQRPDLAVDVLERTADKATVNGLPEKDRETDTSALAAGSSQEVTYAQLDHWALTQRTARAVSPQSTKPMAESITYAAVARH

SEQ ID NO: 51640 - protein, 611 aa, Homo sapiens
MPEIVDTCSLASPASVCRTKHLHLRCSVDFTRRTLTGTAALTVQSQEDNLRSLVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 51641 - protein, 508 aa, Homo sapiens
MLPQRNLSKRQVPTMHIPVKTRRLLAALKVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRMAAALHSIQVGGRNSFGAKDGN

SEQ ID NO: 51642 - protein, 587 aa, Homo sapiens
MLPQRNLSKRQVPTMHIPVKTRRLLAALKVLDTKDLTIEKVVINGQEVKYALGERQSYKGSPMEISLPIALSKNQEIVIEISFETSPKSSALQWLTPEQTSGKEHPYLFSQCQAIHCRAILPCQDTPSVKLTYTAEVSVPKELVALMSAIRDGETPDPEDPSRKIYKFIQKVPIPCYLIALVVGALESRQIGPRTLVWSEKEQVEKSAYEFSETESMLKIAEDLGGPYVWGQYDLLVLPPSFPYGGMENPCLTFVTPTLLAGDKSLSNVIAHEISHSWTGNLVTNKTWDHFWLNEGHTVYLERHICGRLFGEKFRHFNALGGWGELQNSVKTFGETHPFTKLVVDLTDIDPDVAYSSVPYEKGFALLFYLEQLLGGPEIFLGFLKAYVEKFSYKSITTDDWKDFLYSYFKDKVDVLNQVDWNAWLYSPGLPPIKPNYDMTLTNACIALSQRWITAKEDDLNSFNATDLKDLSSHQLNEFLAQTLQRAPLPLGHIKRMQEVYNFNAINNSEIRFRWLRLCIQSKWEDAIPLALKMATEQGRMKFTRPLFKDLAAFDKSHDQAVRTYQEHKASMHPVTAMLVGKDLKVD

SEQ ID NO: 51643 - protein, 352 aa, Homo sapiens
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMYASVLLITAMSLDRSLAVARPFVSQKLRTKAMARRVLAGIWVLSFLLATPVLAYRTVVPWKTNMSLCFPRYPSEGHRAFHLIFEAVTGFLLPFLAVVASYSDIGRRLQARRFRRSRRTGRLVVLIILTFAAFWLPYHVVNLAEAGRALAGQAAGLGLVGKRLSLARNVLIALAFLSSSVNPVLYACAGGGLLRSAGVGFVAKLLEGTGSEASSTRRGGSLGQTARSGPAALEPGPSESLTASSPLKLNELN

SEQ ID NO: 51644 - protein, 352 aa, Homo sapiens; identical to SEQ ID NO: 51643

SEQ ID NO: 51645 - protein, 352 aa, Homo sapiens; identical to SEQ ID NO: 51643

SEQ ID NO: 51646 - protein, 102 aa, Homo sapiens
MNTTSSAAPPSLGVEFISLLAIILLSVALAVGLPGNSFVVWSILKRMQKRSVTALMVLNLALADLAVLLTAPFFLHFLAQGTWSFGLAGCRLCHYVCGVSMY

SEQ ID NO: 51647 - protein, 160 aa, Homo sapiens
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYR

SEQ ID NO: 51648 - protein, 389 aa, Homo sapiens
MAPSHRASQVGFCPTPERPLWRLPPTCRPRRMSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPEWDL

SEQ ID NO: 51649 - protein, 319 aa, Homo sapiens
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGR

SEQ ID NO: 51650 - protein, 358 aa, Homo sapiens
MSVCYRPPGNETLLSWKTSRATGTAFLLLAALLGLPGNGFVVWSLAGWRPARGRPLAATLVLHLALADGAVLLLTPLFVAFLTRQAWPLGQAGCKAVYYVCALSMYASVLLTGLLSLQRCLAVTRPFLAPRLRSPALARRLLLAVWLAALLLAVPAAVYRHLWRDRVCQLCHPSPVHAAAHLSLETLTAFVLPFGLMLGCYSVTLARLRGARWGSGRHGARVGRLVSAIVLAFGLLWAPYHAVNLLQAVAALAPPEGALAKLGGAGQAARAGTTALAFFSSSVNPVLYVFTAGDLLPRAGPRFLTRLFEGSGEARGGGRSREGTMELRTTPQLKVVGQGRGNGDPGGGMEKDGPEWDL

SEQ ID NO: 51651 - protein, 358 aa, Homo sapiens; identical to SEQ ID NO: 51650

SEQ ID NO: 51652 - protein, 150 aa, Homo sapiens
MKDEVALLAAVTLLGVLLQAYFSLQVISARRAFRVSPPLTTGPPEFERVYRAQVNCSEYFPLFLATLWVAGIFFHEGAAALCGLVYLFARLRYFQGYARSAQLRLAPLYASARALWLLVALAALGLLAHFLPAALRAALLGRLRTLLPWA

SEQ ID NO: 51653 - protein, 386 aa, Homo sapiens
MEELDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 51654 - protein, 391 aa, Homo sapiens
MSTLLISSSDALLEELERSTLQDSDEYSNPAPLPLDQHSRKETNLDETSEILSIQDNTSPLPAQLVYTTNIQELNVYSEAQEPKESPPPSKTSAAAQLDELMAHLTEMQAKVAVRADAGKKHLPDKQDHKASLDSMLGGLEQELQDLGIATVPKGHCASCQKPIAGKVIHALGQSWHPEHFVCTHCKEEIGSSPFFERSGLAYCPNDYHQLFSPRCAYCAAPILDKVLTAMNQTWHPEHFFCSHCGEVFGAEGFHEKDKKPYCRKDFLAMFSPKCGGCNRPVLENYLSAMDTVWHPECFVCGDCFTSFSTGSFFELDGRPFCELHYHHRRGTLCHGCGQPITGRCISAMGYKFHPEHFVCAFCLTQLSKGIFREQNDKTYCQPCFNKLFPL

SEQ ID NO: 51655 - protein, 379 aa, Homo sapiens
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 51656 - protein, 250 aa, Homo sapiens
MTPGRCCLAADIQVETFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 51657 - protein, 361 aa, Homo sapiens
MLKRCGRRLLLALAGALLACLLVLTADPPPPPLPAERGRRALRSLAGPAGAAPAPGLGAAAAAPGALVRDVHSLSEYFSLLTRARRDAGPPPGAAPRPADGHPRPLAEPLAPRDVFIAVKTTKKFHRARLDLLLETWISRHKEMTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRWGN

SEQ ID NO: 51658 - protein, 250 aa, Homo sapiens; identical to SEQ ID NO: 51656

SEQ ID NO: 51659 - protein, 308 aa, Homo sapiens
MDEQTGRLRLDTYCMSAKQIWAWSKCSGRLWDEHMKWMEGWTDRWTDGWMDGWMDEWSPTPALRSYGGGLSQQTFIFTDGEDEALARHTGNVVITNCSAAHSRQALSCKMAVEYDRFIESGRKWFCHVDDDNYVNLRALLRLLASYPHTRDVYVGKPSLDRPIQAMERVSENKVRPVHFWFATGGAGFCISRGLALKMSPWASGGHFMNTAERIRLPDDCTIGYIVEALLGVPLIRSGLFHSHLENLQQVPTSELHEQVTLSYGMFENKRNAVHVKGPFSVEADPSRFRSIHCHLYPDTPWCPRTAIF

SEQ ID NO: 51660 - protein, 433 aa, Homo sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGRPGRPSQYRPDGLRSGDGVPPRSLQDGTREGFGHSTSLKVPLARSLQISEELLSRNQLSTAASLGPSGLQNHGQHLILSREASWAKPHYEFNLSRMKFRGNGALSNISDLPFLAENSAFPKMALQAKQDGKKDVSHSSPVDLKIPQVRGMDLSWESRTGDQYSYSSLVMGSQTESALSKKLRAILPKQSRKSMLDAGPDSWGSDAEQSTSGQPYPTSDQEGDPGSKQPRKKRGRYRQYNSEILEEAISVVMSGKMSVSKAQSIYGIPHSTLEYKVKERLGTLKNPPKKKMKLMRSEGPDVSVKIELDPQGEAAQSANESKNE

SEQ ID NO: 51661 - protein, 433 aa, Homo sapiens; identical to SEQ ID NO: 51660

SEQ ID NO: 51662 - protein, 433 aa, Homo sapiens; identical to SEQ ID NO: 51660

SEQ ID NO: 51663 - protein, 406 aa, Homo sapiens
MQRMIQQFAAEYTSKNSSTQDPSQPNSTKNQSLPKASPVTTSPTAATTQNPVLSKLLMADQDSPLDLTVRKSQSEPSEQDGVLDLSTKKSPCAGSTSLSHSPGCSSTQGNGRPGRPSQYRPDGLRSGDGVPPRSLQDGTREGFGHSTSLKVPLARSLQISEELLSRNQLSTAASLGPSGLQNHGQHLILSREASWAKPHYEFNLSRMKFRGNGALSNISDLPFLAENSAFPKMALQAKQDGKKDVSHSSPVDLKIPQVRGMDLSWESRTGDQYSYSSLVMGSQTESALSKKLRAILPKQSRKSMLDAGPDSWGSDAEQSTSGQPYPTSDQEGDPGSKQPRKKRGRYRQYNSEILEEAISVVMSGKMSVSKAQSIYGIPHSTLEYKVKERLGTLKNPPKKKMKLMSG

SEQ ID NO: 51664 - protein, 318 aa, Homo sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGMLQVKTDEKLNVSDENTASCPLSPIKMCLNRPIEWNLNLTTASLTSCTVHNQNLKSEEK

SEQ ID NO: 51665 - protein, 518 aa, Homo sapiens
MDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 51666 - protein, 602 aa, Homo sapiens
MDKGRERMAAAAAAAAAAAAAAQCRSPRCAAERRGFRRELDSWRHRLMHCVGFESILEGLYGPRLRRDLSLFEDCEPEELTDWSMDEKCSFCNLQREAVSDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQGDGVLDLSTKKTSIKSEESSICDPSSENSVAGRLHRNREDYVERSAEFADGLLSKALKDIQSGALDINKAGILYGIPQKTLLLHLEALPAGKPASFKNKTRDFHDSYSYKDSKETCAVLQKVALWARAQAERTEKSKLNLLETSEIKFPTASTYLHQLTLQKMVTQFKEKNESLQYETSNPTVQLKIPQLRVSSVSKSQPDGSGLLDVMYQVSKTSSVLEGSALQKLKNILPKQNKIECSGPVTHSSVDSYFLHGDLSPLCLNSKNGTVDGTSENTEDGLDRKDSKQPRKKRGRYRQYDHEIMEEAIAMVMSGKMSVSKAQGIYGVPHSTLEYKVKERSGTLKTPPKKKLRLPDTGLYNMTDSGTGSCKNSSKPV

SEQ ID NO: 51667 - protein, 144 aa, Homo sapiens
MDHGYEETSVYLKDCIPSLDSSQSTPTEELSSQGQSNTDKIECQAENYLNALFRKKDLPQNCDPNIPLVAQELMKKMIRQFAIEYISKSGKTQENRNGSIGPSIVCKSIQMNQAENSLQEEQEGPLDLTVNRMQEQNTQQACYK

SEQ ID NO: 51668 - protein, 728 aa, Homo sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQTSCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 51669 - protein, 632 aa, Homo sapiens
MKALLLLVLPWLSPANYIDNVGNLHFLYSELCKGASHYGLTKDRKRRSQDGCPDGCASLTATAPSPEVSAAATISLMTDEPGLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 51670 - protein, 6 aa, Homo sapiens
MNQPES

SEQ ID NO: 51671 - protein, 16 aa, Homo sapiens
MNQPESANDPEPLCAV

SEQ ID NO: 51672 - protein, 99 aa, Homo sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLN

SEQ ID NO: 51673 - protein, 90 aa, Homo sapiens
MNQPESANDPEPLCAVCGQAHSLEENHFYSYPEEVDDDLICHICLQALLDPLDTPCGHTYCTLCLTNFLVEKDFCPMDRKPLVLQHCKKS

SEQ ID NO: 51674 - protein, 126 aa, Homo sapiens
MNQPESANDPEPLCAVCGQAHSLEENHFYSYPEEVDDDLICHICLQALLDPLDTPCGHTYCTLCLTNFLVEKDFCPMDRKPLVLQHCKKSSILVNKLLNKLLVTCPFREHCTQVLQRCDLEHHFQT

SEQ ID NO: 51675 - protein, 566 aa, Homo sapiens
MAVQTAVRASQPRLPPLDNPAYVSSAEDGQPAISPVDSGRSNRTRARPFERSTIRSRSFKKINRALSVLRRTKSGSAVANHADQGRENSENTTAPEVFPRLYHLIPDGEITSIKINRVDPSESLSIRLVGGSETPLVHIIIQHIYRDGVIARDGRLLPGDIILKVNGMDISNVPHNYAVRLLRQPCQVLWLTVMREQKFRSRNNGQAPDAYRPRDDSFHVILNKSSPEEQLGIKLVRKVDEPGVFIFNVLDGGVAYRHGQLEENDRVLAINGHDLRYGSPESAAHLIQASERRVHLVVSRQVRQRSPDIFQEAGWNSNGSWSPGPGERSNTPKPLHPTITCHEKVVNIQKDPGESLGMTVAGGASHREWDLPIYVISVEPGGVISRDGRIKTGDILLNVDGVELTEVSRSEAVALLKRTSSSIVLKALEVKEYEPQEDCSSPAALDSNHNMAPPSDWSPSWVMWLELPRCLYNCKDIVLRRNTAGSLGFCIVGGYEEYNGNKPFFIKSIVEGTPAYNDGRIRCGDILLAVNGRSTSGMIHACLARLLKELKGRITLTIVSWPGTFL

SEQ ID NO: 51676 - protein, 690 aa, Homo sapiens [sequence omitted]

SEQ ID NO: 51677 - protein, 704 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 51678 - protein, 756 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 51679 - protein, 756 aa, Homo sapiens; identical to SEQ ID NO: 51678

SEQ ID NO: 51680 - protein, 704 aa, Homo sapiens; identical to SEQ ID NO: 51677

SEQ ID NO: 51681 - protein, 135 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKC

SEQ ID NO: 51682 - protein, 47 aa, Homo sapiens
MLGICRGRRKFLAASLSLLCIPAITWIYLFSGSFEDGKPVSLSPLES

SEQ ID NO: 51683 - protein, 136 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCE

SEQ ID NO: 51684 - protein, 60 aa, Homo sapiens
MLGICRGRRKFLAASLSLLCIPAITWIYLFSGSFEDGKPVSLSPLESQAHSPRYTASSQR

SEQ ID NO: 51685 - protein, 109 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTG

SEQ ID NO: 51686 - protein, 707 aa, Homo sapiens
MLGICRGRRKFLAASLSLLCIPAITWIYLFSGSFEDGKPVSLSPLESQAHSPRYTASSQRERESLEVRMREVEEENRALRRQLSLAQGRAPSHRRGNHSKTYSMEEGTGDSENLRAGIVAGNSSECGQQPVVEKCETIHVAIVCAGYNASRDVVTLVKSVLFHRRNPLHFHLIADSIAEQILATLFQTWMVPAVRVDFYNADELKSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 51687 - protein, 555 aa, Homo sapiens
MLIWSEVSWIPNKHYSGIYGLMKLVLTKTLPANLERVIVLDTDITFATDIAELWAVFHKFKGQQVLGLVENQSDWYLGNLWKNHRPWPALGRGYNTGVILLLLDKLRKMKWEQMWRLTAERELMGMLSTSLADQDIFNAVIKQNPFLVYQLPCFWNVQLSDHTRSEQCYRDVSDLKVIHWNSPKKLRVKNKHVEFFRNLYLTFLEYDGNLLRRELFGCPSEADVNSENLQKQLSELDEDDLCYEFRRERFTVHRTHLYFLHYEYEPAADSTDVTLVAQLSMDRLQMLEAICKHWEGPISLALYLSDAEAQQFLRYAQGSEVLMSRHNVGYHIVYKEGQFYPVNLLRNVAMKHISTPYMFLSDIDFLPMYGLYEYLRKSVIQLDLANTKKAMIVPAFETLRYRLSFPKSKAELLSMLDMGTLFTFRYHVWTKGHAPTNFAKWRTATTPYRVEWEADFEPYVVVRRDCPEYDRRFVGFGWNKVAHIMELDVQEYEFIVLPNAYMIHMPHAPSFDITKFRSNKQYRICLKTLKEEFQQDMSRRYGFAALKYLTAENNS

SEQ ID NO: 51688 - protein, 365 aa, Homo sapiens
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 51689 - protein, 253 aa, Homo sapiens
MFGMQGDVFGLRATFMEGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 51690 - protein, 292 aa, Homo sapiens
MDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYVCELCKGAAPPDSPVVYSDRAGYNKQWHPTCFVCAKCSEPLVDLIYFWKDGAPWCGRHYCESLRPRCSGCDEIIFAEDYQRVEDLAWHRKHFVCEGCEQLLSGRAYIVTKGQLLCPTCSKSKRS

SEQ ID NO: 51691 - protein, 247 aa, Homo sapiens
MAKVAKDLNPGVKKMSLGQLQSARGVACLGCKGTCSGFEPHSWRKICKSCKCSQEDHCLTSDLEDDRKIGRLLMDSKYSTLTARVKGGDGIRIYKRNRMIMTNPIATGKDPTFDTITYEWAPPGVTQKLGLQYMELIPKEKQPVTGTEGAFYRRRQLMHQLPIYDQDPSRCRGLLENELKLMEEFVKQYKSEALGVGEVALPGQGGLPKEEGKQQEKPEGAETTAATTNGSLSDPSKEVEYKPVPLV

SEQ ID NO: 51692 - protein, 261 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 51693 - protein, 166 aa, Homo sapiens
MTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGG

SEQ ID NO: 51694 - protein, 205 aa, Homo sapiens
MLPLRDLQDDTEHEELQGLREEALLQRVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPANYVEAI

SEQ ID NO: 51695 - protein, 261 aa, Homo sapiens; identical to SEQ ID NO: 51692

SEQ ID NO: 51696 - protein, 125 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRSSLGFLWNEIPPSPHL

SEQ ID NO: 51697 - protein, 1349 aa, Homo sapiens
MKKIRICHIFTFYSWMSYDVLFQRTELGALEIWRQLICAHVCICVGWLYLRDRVCSKKDIILRTEQNSGRTILIKAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSRLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNRSVSGKRICSYCNNILGKGAAMIIESLGLCYHLHCFKCVACECDLGGSSSGAEVRIRNHQLYCNDCYLRFKSGRPTAM

SEQ ID NO: 51698 - protein, 1670 aa, Homo sapiens
MKKIRICHIFTFYSWMSYDVLFQRTELGALEIWRQLICAHVCICVGWLYLRDRVCSKKDIILRTEQNSGRTILIKAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNSVLPVSVTSEALPQELKSGSETTNCTATTAISDSNLDGQPPCDVSLHTKALLQIEEEVVAAHVDL

SEQ ID NO: 51699 - protein, 1614 aa, Homo sapiens
MKKIRICHIFTFYSWMSYDVLFQRTELGALEIWRQLICAHVCICVGWLYLRDRVCSKKDIILRTEQNSGRTILIKAVTEKNFETKDFRASLENGVLLCDLINKLKPGVIKKINRLSTPIAGLDNINVFLKACEQIGLKEAQLFHPGDLQDLSNRVTVKQEETDRRVKNVLITLYWLGRKAQSNPYYNGPHLNLKAFENLLGQALTKALEDSSFLKRSGRDSGYGDIWCPERGEFLAPPRHHKREDSFESLDSLGSRSLTSCSSDITLRGGREGFESDTDSEFTFKMQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNSWTANRHVM

SEQ ID NO: 51700 - protein, 1385 aa, Homo sapiens
MQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFSEQDDSVERDIILQCREGELVLPDLEKDDMIVRRIPAQKKEVPLSGAPDRYHPVPFPEPWTLPPEIQAKFLCVLERTCPSKEKSNSCRILVPSYRQKKDDMLTRKIQSWKLGTTVPPISFTPGPCSEADLKRWEAIREASRLRHKKRLMVERLFQKIYGENGSKSMSDVSAEDVQNLRQLRYEEMQKIKSQLKEQDQKWQDDLAKWKDRRKSYTSDLQKKKEEREEIEKQALEKSKRSSKTFKEMLQDRESQNQKSTVPSRRRMYSFDDVLEEGKRPPTMTVSEASYQSERVEEKGATYPSEIPKEDSTTFAKREDRVTTEIQLPSQSPVEEQSPASLSSLRSRSTQMESTRVSASLPRSYRKTDTVRLTSVVTPRPFGSQTRGISSLPRSYTMDDAWKYNGDVEDIKRTPNNVVSTPAPSPDASQLASSLSSQKEVAATEEDVTRLPSPTSPFSSLSQDQAATSKATLSSTSGLDLMSESGEGEISPQREVSRSQDQFSDMRISINQTPGKSLDFGFTIKWDIPGIFVASVEAGSPAEFSQLQVDDEIIAINNTKFSYNDSKEWEEAMAKAQETGHLVMDVRRYGKAGSPETKWIDATSGIYNSEKSSNLSVTTDFSESLQSSNIESKEINGIHDESNAFESKASESISLKNLKRRSQFFEQGSSDSVVPDLPVPTISAPSRWVWDQEEERKRQERWQKEQDRLLQEKYQREQEKLREEWQRAKQEAERENSKYLDEELMVLSSNSMSLTTREPSLATWEATWSEGSKSSDREGTRAGEEERRQPQEEVVHEDQGKKPQDQLVIERERKWEQQLQEEQEQKRLQAEAEEQKRPAEEQKRQAEIERETSVRIYQYRRPVDSYDIPKTEEASSGFLPGDRNKSRSTTELDDYSTNKNGNNKYLDQIGNMTSSQRRSKKEQVPSGAELERQQILQEMRKRTPLHNDNSWIRQRSASVNKEPVSLPGIMRRGESLDNLDSPRSNSWRQPPWLNQPTGFYASSSVQDFSRPPPQLVSTSNRAYMRNPSSSVPPPSAGSVKTSTTGVATTQSPTPRSHSPSASQSGSQLRNSVLPVSVTSEALPQELKSGSETTNCTATTAISDSNLDGQPPCDVSLHTKALLQIEEEVVAAHVDL

SEQ ID NO: 51701 - protein, 759 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 51702 - protein, 760 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSPGDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 51703 - protein, 678 aa, Homo sapiens
MWQGCNCSQLSETAVDQEQLGVLTFILQRTTCLNVSADQEEQIHPRSRLRSPPEALVQGRYPHIKDGEDLKDHSTESKKMENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 51704 - protein, 457 aa, Homo sapiens
MEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 51705 - protein, 111 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSH

SEQ ID NO: 51706 - protein, 130 aa, Homo sapiens
MESSPFNRRQWTSLSLRVTAKELSLVNKNKSSAIVEIFSKYQKAAEETNMEKKRSNTENLSQHFRKGTLTVLKKKWENPGLGAESHTDSLRNSSTEIRHRADHPPAEVTSHAASGAKADQEEQIHPRSRL

SEQ ID NO: 51707 - protein, 456 aa, Homo sapiens
MEQKENVPPGPEVCITHQEGEKISANENSLAVRSTPAEDDSRDSQVKSEVQQPVHPKPLSPDSRASSLSESSPPKAMKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 51708 - protein, 600 aa, Homo sapiens
MENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSPGDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 51709 - protein, 599 aa, Homo sapiens
MENCLGESRHEVEKSEISENTDASGKIEKYNVPLNRLKMMFEKGEPTQTKILRAQSRSASGRKISENSYSLDDLEIGPGQLSSSTFDSEKNESRRNLELPRLSETSIKDRMAKYQAAVSKQSSSTNYTNELKASGGEIKIHKMEQKENVPPGPEVCITHQEGEKISANENSLAVRSTPAEDDSRDSQVKSEVQQPVHPKPLSPDSRASSLSESSPPKAMKKFQAPARETCVECQKTVYPMERLLANQQVFHISCFRCSYCNNKLSLGTYASLHGRIYCKPHFNQLFKSKGNYDEGFGHRPHKDLWASKNENEEILERPAQLANARETPHSPGVEDAPIAKVGVLAASMEAKASSQQEKEDKPAETKKLRIAWPPPTELGSSGSALEEGIKMSKPKWPPEDEISKPEVPEDVDLDLKKLRRSSSLKERSRPFTVAASFQSTSVKSPKTVSPPIRKGWSMSEQSEESVGGRVAERKQVENAKASKKNGNVGKTTWQNKESKGETGKRSKEGHSLEMENENLVENGADSDEDDNSFLKQQSPQEPKSLNWSSFVDNTFAEEFTTQNQKSQDVELWEGEVVKELSVEEQIKRNRYYDEDEDEE

SEQ ID NO: 51710 - protein, 375 aa, Homo sapiens
MLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 51711 - protein, 411 aa, Homo sapiens
MSVGCACPGCSSKSFKLYSPKEPPNGNAFPPFHPGTMLDRDVGPTPMYPPTYLEPGIGRHTPYGNQTDYRIFELNKRLQNWTEECDNLWWDAFTTEFFEDDAMLTITFCLEDGPKRYTIGRTLIPRYFRSIFEGGATELYYVLKHPKEAFHSNFVSLDCDQGSMVTQHGKPMFTQVCVEGRLYLEFMFDDMMRIKTWHFSIRQHRELIPRSILAMHAQDPQMLDQLSKNITRCGLSNSTLNYLRLCVILEPMQELMSRHKTYSLSPRDCLKTCLFQKWQRMVAPPAEPTRQQPSKRRKRKMSGGSTMSSGGGNTNNSNSKKKSPASTFALSSQVPDVMVVGEPTLMGGEFGDEDERLITRLENTQFDAANGIDDEDSFNNSPALGANSPWNSKPPSSQESKSENPTSQASQ

SEQ ID NO: 51712 - protein, 373 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPDVMVVGEPTLMGGEFGDEDERLITRLENTQYDAANGMDDEEDFNNSPALGNNSPWNSKPPATQETKSENPPPQASQ

SEQ ID NO: 51713 - protein, 331 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPGLGAIPNCSLNPGRDGDLCHSTAVTPSGQFKEKH

SEQ ID NO: 51714 - protein, 313 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPIASIARSPVSGCALRT

SEQ ID NO: 51715 - protein, 189 aa, Homo sapiens
MVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQVPIASIARSPVSGCALRT

SEQ ID NO: 51716 - protein, 164 aa, Homo sapiens
MVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLS

SEQ ID NO: 51717 - protein, 110 aa, Homo sapiens
MSSTPHDPFYSSPFGPFYRRHTPYMVQPEYRIYEMNKRLQSRTEDSDNLWWDAFATEFFEDDATLTLSFCLEDGPKRYIVHSAADARGNCNQLGDSEPDACDGLLQFPIM

SEQ ID NO: 51718 - protein, 106 aa, Homo sapiens
MSSTPHDPFYSSPFGPFYRRHTPYMVQPEYRIYEMNKRLQSRTEDSDNLWWDAFATEFFEDDATLTLSFCLEDGPKRYRTKNLRPIGEKMNINGKCYRQDPHPPLL

SEQ ID NO: 51719 - protein, 371 aa, Homo sapiens
MSSTPHDPFYSSPFGPFYRRHTPYMVQPEYRIYEMNKRLQSRTEDSDNLWWDAFATEFFEDDATLTLSFCLEDGPKRYTIGRTLIPRYFSTVFEGGVTDLYYILKHSKESYHNSSITVDCDQCTMVTQHGKPMFTKVCTEGRLILEFTFDDLMRIKTWHFTIRQYRELVPRSILAMHAQDPQVLDQLSKNITRMGLTNFTLNYLRLCVILEPMQELMSRHKTYNLSPRDCLKTCLFQKWQRMVAPPAEPTRQPTTKRRKRKNSTSSTSNSSAGNNANSTGSKKKTTAANLSLSSQDVMVVGEPTLMGGEFGDEDERLITRLENTQYDAANGMDDEEDFNNSPALGNNSPWNSKPPATQETKSENPPPQASQ

SEQ ID NO: 51720 - protein, 617 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 51721 - protein, 330 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 51722 - protein, 470 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 51723 - protein, 727 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSSTPIEHAPVCTSQATTPLLPASAQPPAAASPSAASPPLATAAAHTAIASASTTAPASSPADSPRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 51724 - protein, 398 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 51725 - protein, 283 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKVVVNSPANADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRERFETERNSPRFAKLRNWHHGLSAQILNVKS

SEQ ID NO: 51726 - protein, 732 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGADYQERFNPSALKDSALSTHKPIEVKGLGGKATIIHAQYNTPISMYSQDAIMDAIAGQAQAQGSDFSGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPAPAYTPSPAPAYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 51727 - protein, 617 aa, Homo sapiens; identical to SEQ ID NO: 51720

SEQ ID NO: 51728 - protein, 648 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGSLPIKDLAVDSASPVYQAVIKSQNKPEDEADEWARRSSNLQSRSFRILAQMTGTEFMQDPDEEALRRSRPQASSYSPAVAASSAPATHTSYSEGPAAPAPKPRVVTTASIRPSVYQPVPASTYSPSPGANYSPTPYTPSPVPTYTPSPAPAYTPSPAPNYNPAPSVAYSGGPAEPASRPPWVTDDSFSQKFAPGKSTTSISKQTLPRGGPAYTPAGPQVPPLARGTVQRAERFPASSRTPLCGHCNNVIRGPFLVAMGRSWHPEEFTCAYCKTSLADVCFVEEQNNVYCERCYEQFFAPLCAKCNTKIMGEVMHALRQTWHTTCFVCAACKKPFGNSLFHMEDGEPYCEKDYINLFSTKCHGCDFPVEAGDKFIEALGHTWHDTCFICAVCHVNLEGQPFYSKKDRPLCKKHAHTINL

SEQ ID NO: 51729 - protein, 231 aa, Homo sapiens
MSYSVTLTGPGPWGFRLQGGKDFNMPLTISRITPGSKAAQSQLSQGDLVVAIDGVNTDTMTHLEAQNKIKSASYNLSLTLQKSKRPIPISTTAPPVQTPLPVIPHQKDPALDTNGSLVAPSPSPEARASPGTPGTPELRPTFSPAFSRPSAFSSLAEASDPGPPRASLRAKTSPEGARDLLGPKALPGSSQPRQYNNPIGLYSAETLREMAQMYQMSLRGKASGVGLPGGW

SEQ ID NO: 51730 - protein, 612 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGRCARCGENVVGEGTGCTAMDQVFHVDCFTCIICNNKLRGQPFYAVEKKAYCEPCYINTLEQCNVCSKPIMERILRATGKAYHPHCFTCVMCHRSLDGIPFTVDAGGLIHCIEDFHKKFAPRCSVCKEPIMPAPGQEETVRIVALDRDFHVHCYRCEDCGGLLSEGDNQGCYPLDGHILCKTCNSARIRVLTAKASTDL

SEQ ID NO: 51731 - protein, 93 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPP

SEQ ID NO: 51732 - protein, 151 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTAS

SEQ ID NO: 51733 - protein, 111 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLE

SEQ ID NO: 51734 - protein, 66 aa, Homo sapiens
MSHPSWLPPKSTGEPLGHVPARMETTHSFGNPSISVSTQQPPKKFAPVVAPKPKYNPYKQPGGEGD

SEQ ID NO: 51735 - protein, 53 aa, Homo sapiens
MSHPSWLPPKSTGEPLGHVPARMETTHSFGNPSISVSTQQPPKKFAPVVAPKP

SEQ ID NO: 51736 - protein, 47 aa, Homo sapiens
MSHPSWLPPKSTGEPLGHVPARMETTHSFGNPSISVSTQQPPKKFAP

SEQ ID NO: 51737 - protein, 428 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQPVPVSGQCPPPSTRGGMDYAYIPPPGLQPEPGYGYAPNQGRYYEGYYAAGPGYGGRNDSDPTYGQQGHPNTWKREPGYTPPGAGNQNPPGMYPVTGPKKTYITDPVSAPCAPPLQPKGGHSGQLGPSSVAPSFRPEDELEHLTKKMLYDMENPPADEYFGEWGLELTSEVTILL

SEQ ID NO: 51738 - protein, 65 aa, Homo sapiens
MSHPSWLPPKSTGEPLGHVPARMETTHSFGNPSISVSTQQPPKKFAPVVAPKPKYNPYKQPGGEG

SEQ ID NO: 51739 - protein, 57 aa, Homo sapiens
MSHPSWLPPKSTGEPLGHVPARMETTHSFGNPSISVSTQQPPKKFAPVVAPKPKYNP

SEQ ID NO: 51740 - protein, 612 aa, Homo sapiens; identical to SEQ ID NO: 51730

SEQ ID NO: 51741 - protein, 156 aa, Homo sapiens
MQKKEKSFGIQMLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 51742 - protein, 145 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 51743 - protein, 145 aa, Homo sapiens; identical to SEQ ID NO: 51742

SEQ ID NO: 51744 - protein, 145 aa, Homo sapiens; identical to SEQ ID NO: 51742

SEQ ID NO: 51745 - protein, 145 aa, Homo sapiens; identical to SEQ ID NO: 51742

SEQ ID NO: 51746 - protein, 145 aa, Homo sapiens; identical to SEQ ID NO: 51742

SEQ ID NO: 51747 - protein, 145 aa, Homo sapiens; identical to SEQ ID NO: 51742

SEQ ID NO: 51748 - protein, 145 aa, Homo sapiens; identical to SEQ ID NO: 51742

SEQ ID NO: 51749 - protein, 118 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKF

SEQ ID NO: 51750 - protein, 58 aa, Homo sapiens
MLSVQPDTKPKGCAGCNRKIKDRYLLKALDKYWHEDCLKCACCDCRLGEVGSTLYTKA

SEQ ID NO: 51751 - protein, 97 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNV

SEQ ID NO: 51752 - protein, 118 aa, Homo sapiens; identical to SEQ ID NO: 51749

SEQ ID NO: 51753 - protein, 84 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLI

SEQ ID NO: 51754 - protein, 145 aa, Homo sapiens; identical to SEQ ID NO: 51742

SEQ ID NO: 51755 - protein, 163 aa, Homo sapiens
MLMEGGRAAAARNVSSIQMLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQRFCVGDKFFLKNNMILCQTDYEEGLMKEGYAPQVR

SEQ ID NO: 51756 - protein, 145 aa, Homo sapiens; identical to SEQ ID NO: 51742

SEQ ID NO: 51757 - protein, 125 aa, Homo sapiens [sequence omitted]

SEQ ID NO: 51758 - protein, 88 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLIPAFE

SEQ ID NO: 51759 - protein, 110 aa, Homo sapiens
MLSVQPDTKPKGCAGCNRKIKDRYLLKALDKYWHEDCLKCACCDCRLGEVGSTLYTKANLILCRRDYLRLFGVTGNCAACSKLIPAFEMVMRAKDNVYHLDCFACQLCNQ

SEQ ID NO: 51760 - protein, 118 aa, Homo sapiens; identical to SEQ ID NO: 51749

SEQ ID NO: 51761 - protein, 165 aa, Homo sapiens
MVNPGSSSQPPPVTAGSLSWKRCAGCGGKIADRFLLYAMDSYWHSRCLKCSCCQAQLGDIGTSCYTKSGMILCRNDYIRLFGNSGACSACGQSIPASELVMRAQGNVYHLKCFTCSTCRNRLVPGDRFHYINGSLFCEHDRPTALINGHLNSLQSNPLLPDQKVC

SEQ ID NO: 51762 - protein, 165 aa, Homo sapiens; identical to SEQ ID NO: 51761

SEQ ID NO: 51763 - protein, 676 aa, Homo sapiens
MDKYDDLGLEASKFIEDLNMYEASKDGLFRVDKGAGNNPEFEETRRVFATKMAKIHLQQQQQQLLQEETLPRGSRGPVNGGGRLGPQARWEVVGSKLTVDGAAKPPLAASTGAPGAVTTLAAGQPPYPPQEQRSRPYLHGTRHGSQDCGSRESLATSEMSAFHQPGPCEDPSCLTHGDYYDNLSLASPKWGDKPGVSPSIGLSVGSGWPSSPGSDPPLPKPCGDHPLNHRQLSLSSSRSSEGSLGGQNSGIGGRSSEKPTGLWSTASSQRVSPGLPSPNLENGAPAVGPVQPRTPSVSAPLALSCPRQGGLPRSNSGLGGEVSGVMSKPNVDPQPWFQDGPKSYLSSSAPSSSPAGLDGSQQGAVPGLGPKPGCTDLGTGPKLSPTSLVHPVMSTLPELSCKEGPLGWSSDGSLGSVLLDSPSSPRVRLPCQPLVPGPELRPSAAELKLEALTQRLEREMDAHPKADYFGACVKCSKGVFGAGQACQAMGNLYHDTCFTCAACSRKLRGKAFYFVNGKVFCEEDFLYSGFQQSADRCFLCGHLIMDMILQALGKSYHPGCFRCVICNECLDGVPFTVDSENKIYCVRDYHKVLAPKCAACGLPILPPEGSDETIRVVSMDRDYHVECYHCEDCGLELNDEDGHRCYPLEDHLFCHSCHVKRLEKRPSSTALHQHHF

SEQ ID NO: 51764 - protein, 406 aa, Homo sapiens
MVHCAGCKRPILDRFLLNVLDRAWHVKCVQCCECKCNLTEKCFSREGKLYCKNDFFRCFGTKCAGCAQGISPSDLVRRARSKVFHLNCFTCMMCNKQLSTGEELYIIDENKFVCKEDYLSNSSVAKENSLHSATTGSDPSLSPDSQDPSQDDAKDSESANVSDKEAGSNENDDQNLGAKRRGPRTTIKAKQLETLKAAFAATPKPTRHIREQLAQETGLNMRVIQVWFQNRRSKERRMKQLSALGARRHAFFRSPRRMRPLVDRLEPGELIPNGPFSFYGDYQSEYYGPGGNYDFFPQGPPSSQAQTPVDLPFVPSSGPSGTPLGGLEHPLPGHHPSSEAQRFTDILAHPPGDSPSPEPSLPGPLHSMSAEVFGPSPPFSSLSVNGGASYGNHLSHPPEMNEAAVW

SEQ ID NO: 51765 - protein, 406 aa, Homo sapiens
MLFHSLSGPEVHGVIDEMDRRAKSEAPAISSAIDRGDTETTMPSISSDRAALCAGCGGKISDRYYLLAVDKQWHMRCLKCCECKLNLESELTCFSKDGSIYCKEDYYRRFSVQRCARCHLGISASEMVMRARDLVYHLNCFTCTTCNKMLTTGDHFGMKDSLVYCRLHFEALLQGEYPAHFNHADVAAAAAAAAAAKSAGLGAAGANPLGLPYYNGVGTVQKGRPRKRKSPGPGADLAAYNAALSCNENDAEHLDRDQPYPSSQKTKRMRTSFKHHQLRTMKSYFAINHNPDAKDLKQLAQKTGLTKRVLQVWFQNARAKFRRNLLRQENTGVDKSTDAALQTGTPSGPASELSNASLSPSSTPTTLTDLTSPTLPTVTSVLTSVPGNLEGHEPHSPSQTTLTNLF

SEQ ID NO: 51766 - protein, 397 aa, Homo sapiens
MEARGELGPARESAGGDLLLALLARRADLRREIPLCAGCDQHILDRFILKATATGTASVSSAATATPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPVSLPWRKWARPMASTGAWGHPGLGPALGSPGQLLPGAWRPGRPRAVPRAASRQPLRCPPIPRRPAEPPWPPLLSSLVYPDTSLGLVPSGAPGGPPPMRVLAGNGPSSDLSTGSSGGYPDFPASPASWLDEVDHAQF

SEQ ID NO: 51767 - protein, 402 aa, Homo sapiens
MEARGELGPARESAGGDLLLALLARRADLRREIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 51768 - protein, 397 aa, Homo sapiens
MLLETGLERDRARPGAAAVCTLGGTREIPLCAGCDQHILDRFILKALDRHWHSKCLKCSDCHTPLAERCFSRGESVYCKDDFFKRFGTKCAACQLGIPPTQVVRRAQDFVYHLHCFACVVCKRQLATGDEFYLMEDSRLVCKADYETAKQREAEATAKRPRTTITAKQLETLKSAYNTSPKPARHVREQLSSETGLDMRVVQVWFQNRRAKEKRLKKDAGRQRWGQYFRNMKRSRGGSKSDKDSVQEGQDSDAEVSFPDEPSLAEMGPANGLYGSLGEPTQALGRPSGALGNFSLEHGGLAGPEQYRELRPGSPYGVPPSPAAPQSLPGPQPLLSSLVYPDTSLGLVPSGAPGGPPPMRVLAGNGPSSDLSTGSSGGYPDFPASPASWLDEVDHAQF

SEQ ID NO: 51769 - protein, 390 aa, Homo sapiens
MMQSATVPAEGAVKGLPEMLGVPMQQIPQCAGCNQHILDKFILKVLDRHWHSSCLKCADCQMQLADRCFSRAGSVYCKEDFFKRFGTKCTACQQGIPPTQVVRKAQDFVYHLHCFACIICNRQLATGDEFYLMEDGRLVCKEDYETAKQNDDSEAGAKRPRTTITAKQLETLKNAYKNSPKPARHVREQLSSETGLDMRVVQVWFQNRRAKEKRLKKDAGRHRWGQFYKSVKRSRGSSKQEKESSAEDCGVSDSELSFREDQILSELGHTNRIYGNVGDVTGGQLMNGSFSMDGTGQSYQDLRDGSPYGIPQSPSSISSLPSHAPLLNGLDYTVDSNLGIIAHAGQGVSQTLRAMAGGPTSDISTGSSVGYPDFPTSPGSWLDEMDHPPF

SEQ ID NO: 51770 - protein, 402 aa, Homo sapiens
MMVHCAGCERPILDRFLLNVLDRAWHIKCVQCCECKTNLSEKCFSREGKLYCKNDFFRRFGTKCAGCAQGISPSDLVRKARSKVFHLNCFTCMVCNKQLSTGEELYVIDENKFVCKDDYLSSSSLKEGSLNSVSSCTDRSLSPDLQDALQDDPKETDNSTSSDKETANNENEEQNSGTKRRGPRTTIKAKQLETLKAAFAATPKPTRHIREQLAQETGLNMRVIQVWFQNRRSKERRMKQLSALGARRHAFFRSPRRMRPLGGRLDESEMLGSTPYTYYGDYQGDYYAPGSNYDFFAHGPPSQAQSPADSSFLAASGPGSTPLGALEPPLAGPHAADNPRFTDMISHPDTPSPEPGLPGTLHPMPGEVFSGGPSPPFPMSGTSGYSGPLSHPNPELNEAAVW

SEQ ID NO: 51771 - protein, 356 aa, Homo sapiens
MQILSRCQGLMSEECGRTTALAAGRTRKGAGEEGLVSPEGAGDEDSCSSSAPLSPSSSPRSMASGSGCPPGKCVCNSCGLEIVDKYLLKVNDLCWHVRCLSCSVCRTSLGRHTSCYIKDKDIFCKLDYFRRYGTRCSRCGRHIHSTDWVRRAKGNVYHLACFACFSCKRQLSTGEEFALVEEKVLCRVHYDCMLDNLKREVENGNGISVEGALLTEQDVNHPKPAKRARTSFTADQLQVMQAQFAQDNNPDAQTLQKLAERTGLSRRVIQVWFQNCRARHKKHVSPNHSSSTPVTAVPPSRLSPPMLEEMAYSAYVPQDGTMLTALHSYMDAHSPTTLGLQPLLPHSMTQLPISHT

SEQ ID NO: 51772 - protein, 346 aa, Homo sapiens
MSEECGRTTALAAGRTRKGAGEEGLVSPEGAGDEDSCSSSAPLSPSSSPRSMASGSGCPPGKCVCNSCGLEIVDKYLLKVNDLCWHVRCLSCSVCRTSLGRHTSCYIKDKDIFCKLDYFRRYGTRCSRCGRHIHSTDWVRRAKGNVYHLACFACFSCKRQLSTGEEFALVEEKVLCRVHYDCMLDNLKREVENGNGISVEGALLTEQDVNHPKPAKRARTSFTADQLQVMQAQFAQDNNPDAQTLQKLAERTGLSRRVIQVWFQNCRARHKKHVSPNHSSSTPVTAVPPSRLSPPMLEEMAYSAYVPQDGTMLTALHSYMDAHSPTTLGLQPLLPHSMTQLPISHT

SEQ ID NO: 51773 - protein, 397 aa, Homo sapiens
MEIVGCRAEDNSCPFRPPAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQVWFQNARAKFRRNLLRQENGGVDKADGTSLPAPPSADSGALTPPGTATTLTDLTNPTITVVTSVTSNMDSHESGSPSQTTLTNLF

SEQ ID NO: 51774 - protein, 388 aa, Homo sapiens
MLNGTTLEAAMLFHGISGGHIQGIMEEMERRSKTEARLAKGAQLNGRDAGMPPLSPEKPALCAGCGGKISDRYYLLAVDKQWHLRCLKCCECKLALESELTCFAKDGSIYCKEDYYRRFSVQRCARCHLGISASEMVMRARDSVYHLSCFTCSTCNKTLTTGDHFGMKDSLVYCRAHFETLLQGEYPPQLSYTELAAKSGGLALPYFNGTGTVQKGRPRKRKSPALGVDIVNYNSGCNENEADHLDRDQQPYPPSQKTKRMRTSFKHHQLRTMKSYFAINHNPDAKDLKQLAQKTGLTKRVLQVWFQNARAKFRRNLLRQENGGVDKADGTSLPAPPSADSGALTPPGTATTLTDLTNPTITVVTSVTSNMDSHESGSPSQTTLTNLF

SEQ ID NO: 51775 - protein, 382 aa, Homo sapiens
MLDGLKMEENFQSAIDTSASFSSLLGRAVSPKSVCEGCQRVILDRFLLRLNDSFWHEQCVQCASCKEPLETTCFYRDKKLYCKYDYEKLFAVKCGGCFEAIAPNEFVMRAQKSVYHLSCFCCCVCERQLQKGDEFVLKEGQLLCKGDYEKERELLSLVSPAASDSGKSDDEESLCKSAHGAGKGTAEEGKDHKRPKRPRTILTTQQRRAFKASFEVSSKPCRKVRETLAAETGLSVRVVQVWFQNQRAKMKKLARRQQQQQQDQQNTQRLSSAQTNGGGSAGMEGIMNPYTALPTPQQLLAIEQSVYSSDPFRQGLTPPQMPGDHMHPYGAEPLFHDLDSDDTSLSNLGDCFLATSEAGPLQSRVGNPIDHLYSMQNSYFTS

SEQ ID NO: 51776 - protein, 382 aa, Homo sapiens; identical to SEQ ID NO: 51775

SEQ ID NO: 51777 - protein, 382 aa, Homo sapiens; identical to SEQ ID NO: 51775

SEQ ID NO: 51778 - protein, 406 aa, Homo sapiens
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQGEPGPGQGLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 51779 - protein, 402 aa, Homo sapiens
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGDHMNPYGNDSIFHDIDSDTSLTSLSDCFLGSSDVGSLQARVGNPIDRLYSMQSSYFAS

SEQ ID NO: 51780 - protein, 372 aa, Homo sapiens
MLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 51781 - protein, 395 aa, Homo sapiens
MDIATGPESLERCFPRGQTDCAKMLDGIKMEEHALRPGPATLGVLLGSDCPHPAVCEGCQRPISDRFLMRVNESSWHEECLQCAACQQALTTSCYFRDRKLYCKQDYQQLFAAKCSGCMEKIAPTEFVMRALECVYHLGCFCCCVCERQLRKGDEFVLKEGQLLCKGDYEKEKDLLSSVSPDESDSVKSEDEDGDMKPAKGQGSQSKGSGDDGKDPRRPKRPRTILTTQQRRAFKASFEVSSKPCRKVRETLAAETGLSVRVVQVWFQNQRAKMKKLARRHQQQQEQQNSQRLGQEVLSSRMEGMMASYTPLAPPQQQIVAMEQSPYGSSDPFQQGLTPPQMPGNDSIFHDIDSDTSLTSLSDCFLGSSDVGSLQARVGNPIDRLYSMQSSYFAS

SEQ ID NO: 51782 - protein, 105 aa, Homo sapiens
MSIYFPIHCPDYLRSAKMTEVMMNTQPMEEIGLSPRKDGLSYQIFPDPSDFDRCCKLKDRLPSIVVEPTEGEVESGELRWPPEEFLVQEDEQDNCEETAKENKEQ

SEQ ID NO: 51783 - protein, 87 aa, Homo sapiens
MVSSVVGFYSLRFFGNFTPKKDDTTMTKIIGNCVSILVLSSALPVMSRTLGLHKLHLPNTSRDSETASVMTSSARDTGFHHLQALMC

SEQ ID NO: 51784 - protein, 228 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLHLPNTSRDSETAKPSVNGHQKAL

SEQ ID NO: 51785 - protein, 490 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 51786 - protein, 531 aa, Homo sapiens
MEGQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNVGMLCAGNPEVATGRQVPEEQAGQLLLGKWIQEGGDMIANPRLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 51787 - protein, 284 aa, Homo sapiens
MLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGLHKLHLPNTSRDSETAKPSVNGHQKAL

SEQ ID NO: 51788 - protein, 529 aa, Homo sapiens
GQDEVSAREQHFHSQVRESTICFLLFAILYVVSYFIITRYKRKSDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNVGMLCAGNPEVATGRQVPEEQAGQLLLGKWIQEGGDMIANPRLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGITRFDLLGDFGRFNWLGNFYIVLSYNLLFAIVTTLCLVRKFTSAVREELFKALGLHKLHLPNTSRDSETAKPSVNGHQKAL

SEQ ID NO: 51789 - protein, 415 aa, Homo sapiens
MKEDGRAGRGVGAGAALPQPSAGVHDEQEDEDAIVNRISLFLSTFTLAVSAGAVLLLPFSIISNEILLSFPQNYYIQWLNGSLIHGLWNLASLFSNLCLFVLMPFAFFFLESEGFAGLKKGIRARILETLVMLLLLALLILGIVWVASALIDNDAASMESLYDLWEFYLPYLYSCISLMGCLLLLLCTPVGLSRMFTVMGQLLVKPTILEDLDEQIYIITLEEEALQRRLNGLSSSVEYNIMELEQELENVKTLKTKLERRKKASAWERNLVYPAVMVLLLIETSISVLLVACNILCLLVDETAMPKGTRGPGIGNASLSTFGFVGAALEIILIFYLMVSSVVGFYSLRFFGNFTPKKDDTTMTKIIGNCVSILVLSSALPVMSRTLGLHKLHLPNTSRDSETAKPSVNGHQKAL

SEQ ID NO: 51790 - protein, 489 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 51791 - protein, 484 aa, Homo sapiens
MVNVKALCEPEVSNCWMNVITGTGSVSSPLLVLPQPGPETSLMTGEPVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQGTSLGQVSFSKLGSFGAVIQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 51792 - protein, 469 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRICNPTSCWLPLDMELLHRQVLALQTQRVLLEKRRKASAWQRNLGYPLAMLCLLVLTGLSVLIVAIHILELLIDEAAMPRGMQVVLIFYLMVSSVVGFYSSPLFRSLRPRWHDTAMTQIIGNCVCLLVLSSALPVFSRTLGLTRFDLLGDFGRFNWLGNFYIVFLYNAAFAGLTTLCLVKTFTAAVRAELIRAFGLDRLPLPVSGFPQASRKTQHQ

SEQ ID NO: 51793 - protein, 127 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFL

SEQ ID NO: 51794 - protein, 338 aa, Homo sapiens
MVRRVQPDRKQLPLVLLRLLCLLPTGLPVRSVDFNRGTDNITVRQGDTAILRCVVEDKNSKVAWLNRSGIIFAGHDKWSLDPRVELEKRHSLEYSLRIQKVDVYDEGSYTCSVQTQHEPKTSQVYLIVQVPPKISNISSDVTVNEGSNVTLVCMANGRPEPVITWRHLTPTGREFEGEEEYLEILGITREQSGKYECKAANEVSSADVKQVKVTVNYPPTITESKSNEATTGRQASLKCEASAVPAPDFEWYRDDTRINSANGLEIKSTEGQSSLTVTNVTEEHYGNYTCVAANKLGVTNASLVLFRPGSVRGINGSISLAVPLWLLAASLLCLLSKC

SEQ ID NO: 51795 - protein, 358 aa, Homo sapiens [sequence omitted]

SEQ ID NO: 51796 - protein, 250 aa, Homo sapiens
MAEGGASKGGGEEPGKLPEPAEEESQVLRGTGHCKWFNVRMGFGFISMINREGSPLDIPVDVFVHQSKLFMEGFRSLKEGEPVEFTFKKSSKGLESIRVTGPGGSPCLGSERRPKGKTLQKRKPKGDRCYNCGGLDHHAKECSLPPQPKKCHYCQSIMHMVANCPHKNVAQPPASSQGRQEAESQPCTSTLPREVGGGHGCTSPPFPQEARAEISERSGRSPQEASSTKSSIAPEEQSKKGPSVQKRKKT

SEQ ID NO: 51797 - protein, 749 aa, Homo sapiens
MEVVPAEVNSLLPEEIMDTGITLVDDDSIEAVIVSSPIPMETELEEIVNINSTGDSTATPISTEPITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQIAKKPRTPTSGPVITKLIFAKPINSKAVTGQTTQVSPPVIAGRVLSQSTPGTPSKTITISESGVIGSTLNSTTQTPNKIAISPLKSPNKAVKSTVQTITVGGVSTSQFKTIIPLATAPNVQQIQVPGSKFHYVRLVTATSASSSTQPVSQNPSTNTQPLQQAKPVVVNTTPVRMSVPIVSAQAVKQVVPKPINPTSQIVTTSQPQQRLIMPATPLPQIQPNLTNLPPGTVLAPAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSDPCAMNC

SEQ ID NO: 51798 - protein, 243 aa, Homo sapiens
MEVVPAEVNSLLPEEIMDTGITLVDDDSIEAVIVSSPIPMETELEEIVNINSTGDSTATPISTEPITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQVGFFHSLLPELHQRP

SEQ ID NO: 51799 - protein, 660 aa, Homo sapiens
MEVVPAEVNSLLPEEIMDTGITLVDDDSIEAVIVSSPIPMETELEEIVNINSTGDSTATPISTEPITVYSNHTNQVAVNTTITKADSNTTVKPAFPSGLQKLGAQTPVTISANQIILNKVSQTSDLKLGNQTLKPDGQKLILTTLGKSGSPIVLALPHSQLPQAQKVTTQAQSGDAKLPPQQIKVVTIGGRPEVKPVIGVSALTPGSQLINTTTQPSVLQTQQLKTVQAVKSTVQTITVGGVSTSQFKTIIPLATAPNVQQIQVPGSKFHYVRLVTATSASSSTQPVSQNPSTNTQPLQQAKPVVVNTTPVRMSVPIVSAQAVKQVVPKPINPTSQIVTTSQPQQRLIMPATPLPQIQPNLTNLPPGTVLAPAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSDPCAMNC

SEQ ID NO: 51800 - protein, 528 aa, Homo sapiens
MEVVPAEIAKKPRTPTSGPVITKLIFAKPINSKAVTGQTTQVSPPVIAGRVLSQSTPGTPSKTITISESGVIGSTLNSTTQTPNKIAISPLKSPNKAVKSTVQTITVGGVSTSQFKTIIPLATAPNVQQIQVPGSKFHYVRLVTATSASSSTQPVSQNPSTNTQPLQQAKPVVVNTTPVRMSVPIVSAQAVKQVVPKPINPTSQIVTTSQPQQRLIMPATPLPQIQPNLTNLPPGTVLAPAPGTGNVGYAVLPAQYVTQLQQSSYVSIASNSTFTGTSGIQTQARLPFNGIIPSESASRPRKPCNCTKSLCLKLYCDCFANGEFCNNCNCTNCYNNLEHENERQKAIKACLDRNPEAFKPKIGKGKEGESDRRHSKGCNCKRSGCLKNYCECYEAKIMCSSICKCIGCKNFEESPERKTLMHLADAAEVRVQQQTAAKTKLSSQISDLLTRPTPALNSGGGKLPFTFVTKEVAEATCNCLLAQAEQADKKGKSKAAAERMILEEFGRCLMSVINSAGKAKSDPCAMNC

SEQ ID NO: 51801 - protein, 528 aa, Homo sapiens; identical to SEQ ID NO: 51800

SEQ ID NO: 51802 - protein, 749 aa, Homo sapiens; identical to SEQ ID NO: 51797

SEQ ID NO: 51803 - protein, 528 aa, Homo sapiens; identical to SEQ ID NO: 51800

SEQ ID NO: 51804 - protein, 207 aa, Homo sapiens
MAALVEPLGLERDVSRAVELLERLQRSGELPPQKLQALQRVLQSRFCSAIREVYEQLYDTLDITGSAEIRAHATAKATVAAFTASEGHAHPRVVELPKTDEGLGFNIMGGKEQNSPIYISRVIPGGVADRHGGLKRGDQLLSVNGVSVEGEQHEKAVELLKAAQGSVKLVVRYTPRVLEEMEARFEKMRSARRRQQHQSYSSLESRG

SEQ ID NO: 51805 - protein, 197 aa, Homo sapiens
MAALGEPVRLERDICRAIELLEKLQRSGEVPPQKLQALQRVLQSEFCNAVREVYEHVYETVDISSSPEVRANATAKATVAAFAASEGHSHPRVVELPKTEEGLGFNIMGGKEQNSPIYISRIIPGGIADRHGGLKRGDQLLSVNGVSVEGEHHEKAVELLKAAQGKVKLVVRYTPKVLEEMESRFEKMRSAKRRQQT

SEQ ID NO: 51806 - protein, 252 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 51807 - protein, 262 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 51808 - protein, 233 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 51809 - protein, 269 aa, Homo sapiens
MEATAASWQVAVPVLGGASRPLGPRGAASLLRAPLQMEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 51810 - protein, 232 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPSPQPLGGSHRTPSSRRDSDGANSVASYENEEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDYENLQELN

SEQ ID NO: 51811 - protein, 243 aa, Homo sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSKGSRHGSEEAYIDPIAMEYYNWGRFSKPPEDDDANSYENVLICKQKTTETGAQQEGIGGLCRGDLSLSLALKTGPTSGLCPSASPEEDEESEDYQNSASIHQWRESRKVMGQLQREASPGPVGSPDEEDGEPDYVNGEVAATEA

SEQ ID NO: 51812 - protein, 243 aa, Homo sapiens; identical to SEQ ID NO: 51811

SEQ ID NO: 51813 - protein, 64 aa, Homo sapiens
MSSGTELLWPGAALLVLLGVAASLCVRCSRPGAKRSEKIYQQRSLREDQQSFTGSRTYSLVGQA

SEQ ID NO: 51814 - protein, 243 aa, Homo sapiens; identical to SEQ ID NO: 51811

SEQ ID NO: 51815 - protein, 243 aa, Homo sapiens; identical to SEQ ID NO: 51811

SEQ ID NO: 51816 - protein, 58 aa, Homo sapiens
MSSGTELLWPGAALLVLLGVAASLCVRCSRPGAKRSEKIYQQRSLREDQQSFTGSRTY

SEQ ID NO: 51817 - protein, 100 aa, Homo sapiens
MSSGTELLWPGAALLVLLGVAASLCVRCSRPGAKRSEKIYQQRSLREDQQSFTGSRTYSLVGQAWPGPLADMAPTRKDKLLQFYPSLEDPASSRYQNFSK

SEQ ID NO: 51818 - protein, 567 aa, Homo sapiens
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 51819 - protein, 567 aa, Homo sapiens
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFRWESQLLETGFLGIFLCPLWTLSRLPQHTPTSRIVLWGFRWLIFRIMLGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 51820 - protein, 185 aa, Homo sapiens
MRPDSPTMAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWCPSLASAISLPSMHGGQ

SEQ ID NO: 51821 - protein, 166 aa, Homo sapiens
MAAPAESLRRRKTGYSDPEPESPPAPGRGPAGSPAHLHTGTFWLTRIVLLKALAFVYFVAFLVAFHQNKQLIGDRGLLPCRVFLKNFQQYFQDRTSWEVFSYMPTILWLMDWSDMNSNLDLLALLGLGISSFVLITGCANMLLMAALWGLYMSLVNVGHVWYSFGK

SEQ ID NO: 51822 - protein, 350 aa, Homo sapiens
MRGAGLIKIRGDRCWRDLTCMDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 51823 - protein, 330 aa, Homo sapiens
MDFHYETQPMPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPPRWVRGEHYRYKFSRPGGRHAAEGKWWVRKRIGAYFPPLSLEELRPYFRDRGWPLPGPL

SEQ ID NO: 51824 - protein, 263 aa, Homo sapiens
MPNPVAYYLHHSPWWFHRFETLSNHFIELLVPFFLFLGRRACIIHGVLQILFQAVLIVSGNLSFLNWLTMVPSLACFDDATLGFLFPSGPGSLKDRVLQMQRDIRGARPEPRFGSVVRRAANVSLGVLLAWLSVPVVLNLLSSRQVMNTHFNSLHIVNTYGAFGSITKERAEVILQGTASSNASAPDAMWEDYEFKCKPGDPSRRPCLISPYHYRLDWLMWFAAFQTYEHNDWIIHLAGKLLASDAEALSLLAHNPFAGRPPP

SEQ ID NO: 51825 - protein, 500 aa, Homo sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITGLDPAGPMFEGADIHKRLSPDDADFVDVLHTYTRSFGLSIGIQMPVGHIDIYPNGGDFQPGCGLNDVLGSIAYGTITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 51826 - protein, 426 aa, Homo sapiens
MSNSVPLLCFWSLCYCFAAGSPVPFGPEGRLEDKLHKPKATQTEVKPSVRFNLRTSKDPEHEGCYLSVGHSQPLEDCSFNMTAKTFFIIHGWTMSGIFENWLHKLVSALHTREKDANVVVVDWLPLAHQLYTDAVNNTRVVGHSIARMLDWLQEKDDFSLGNVHLIGYSLGAHVAGYAGNFVKGTVGRITAITEVVKCEHERAVHLFVDSLVNQDKPSFAFQCTDSNRFKKGICLSCRKNRCNSIGYNAKKMRNKRNSKMYLKTRAGMPFRVYHYQMKIHVFSYKNMGEIEPTFYVTLYGTNADSQTLPLEIVERIEQNATNTFLVYTEEDLGDLLKIQLTWEGASQSWYNLWKEFRSYLSQPRNPGRELNIRRIRVKSGETQRKLTFCTEDPENTSISPGRELWFRKCRDGWRMKNETSPTVELP

SEQ ID NO: 51827 - protein, 366 aa, Homo sapiens
MNISQIISYWGYPDEEYDIVTEDGYILGLYRIPYWRTDNNKNLAQRVVVYLQHGLLTSASSWISNLPNNSLGFILADAGYDVWMGNSRGNTWSRKHLYLETSSKEFWAFSFDEMAKYDLPASIDFTVKQTRQEEIFYVGHSQGTTIGFITFSTISKIAERIKIFFALAPVFSTKYLKSPLIRMTYKWKSIVMAFSGNKDFLPKTSFKKFIGSKLCPLQIFDKICLNILFMMFGYDPKNLNMSRLDVYFSHNPAGTSVQNMLHWSQLLNSTHLKAYDWGSPDLNLVHYNQTTSPLYNMTNMNVATAIWNGKSDLLADPEDVNILHSEITNHIYYKTISYYNHIDSLFGLDVYDQVYHEIIDIIQDNL

SEQ ID NO: 51828 - protein, 399 aa, Homo sapiens
MWQLLAAACWMLLLGSMYGYDKKGNNANPEANMNISQIISYWGYPYEEYDVTTKDGYILGIYRIPHGRGCPGRTAPKPAVYLQHGLIASASNWICNLPNNSLAFLLADSGYDVWLGNSRGNTWSRKHLKLSPKSPEYWAFSLDEMAKYDLPATINFIIEKTGQKRLYYVGHSQGTTIAFIAFSTNPELAKKIKIFFALAPVVTVKYTQSPMKKLTTLSRRVVKVLFGDKMFHPHTLFDQFIATKVCNRKLFRRICSNFLFTLSGFDPQNLNMSRLDVYLSHNPAGTSVQNMLHWAQAVNSGQLQAFDWGNSDQNMMHFHQLTPPLYNITKMEVPTAIWNGGQDIVADPKDVENLLPQIANLIYYKLIPHYNHVDFYLGEDAPQEIYQDLIILMEEYLQN

SEQ ID NO: 51829 - protein, 423 aa, Homo sapiens
MLETLSRQWIVSHRMEMWLLILVAYMFQRNVNSVHMPTKAVDPEAFMNISEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 51830 - protein, 383 aa, Homo sapiens
MTRPLDRKQSEIIQHQGYPCEEYEVATEDGYILSVNRIPRGLVQPKKTGSRPVVLLQHGLVGGASNWISNLPNNSLGFILADAGFDVWMGNSRGNAWSRKHKTLSIDQDEFWAFSYDEMARFDLPAVINFILQKTGQEKIYYVGYSQGTTMGFIAFSTMPELAQKIKMYFALAPIATVKHAKSPGTKFLLLPDMMIKGLFGKKEFLYQTRFLRQLVIYLCGQVILDQICSNIMLLLGGFNTNNMNMSRASVYAAHTLAGTSVQNILHWSQAVNSGELRAFDWGSETKNLEKCNQPTPVRYRVRDMTVPTAMWTGGQDWLSNPEDVKMLLSEVTNLIYHKNIPEWAHVDFIWGLDAPHRMYNEIIHLMQQEETNLSQGRCEAVL

SEQ ID NO: 51831 - protein, 398 aa, Homo sapiens
MMWLLLTTTCLICGTLNAGGFLDLENEVNPEVWMNTSEIIIYNGYPSEEYEVTTEDGYILLVNRIPYGRTHARSTGPRPVVYMQHALFADNAYWLENYANGSLGFLLADAGYDVWMGNSRGNTWSRRHKTLSETDEKFWAFSFDEMAKYDLPGVIDFIVNKTGQEKLYFIGHSLGTTIGFVAFSTMPELAQRIKMNFALGPTISFKYPTGIFTRFFLLPNSIIKAVFGTKGFFLEDKKTKIASTKICNNKILWLICSEFMSLWAGSNKKNMNQSRMDVYMSHAPTGSSVHNILHIKQLYHSDEFRAYDWGNDADNMKHYNQSHPPIYDLTAMKVPTAIWAGGHDVLVTPQDVARILPQIKSLHYFKLLPDWNHFDFVWGLDAPQRMYSEIIALMKAYS

SEQ ID NO: 51832 - protein, 499 aa, Homo sapiens
MDTSPLCFSILLVLCIFIQSSALGQSLKPEPFGRRAQAVETNKTLHEMKTRFLLFGETNQGCQIRINHPDTLQECGFNSSLPLVMIIHGWSVDGVLENWIWQMVAALKSQPAQPVNVGLVDWITLAHDHYTIAVRNTRLVGKEVAALLRWLEESVQLSRSHVHLIGYSLGAHVSGFAGSSIGGTHKIGRITGLDAAGPLFEGSAPSNRLSPDDANFVDAIHTFTREHMGLSVGIKQPIGHYDFYPNGGSFQPGCHFLELYRHIAQHGFNAITQTIKCSHERSVHLFIDSLLHAGTQSMAYPCGDMNSFSQGLCLSCKKGRCNTLGYHVRQEPRSKSKRLFLVTRAQSPFKVYHYQFKIQFINQTETPIQTTFTMSLLGTKEKMQKIPITLGKGIASNKTYSFLITLDVDIGELIMIKFKWENSAVWANVWDTVQTIIPWSTGPRHSGLVLKTIRVKAGETQQRMTFCSENTDDLLLRPTQEKIFVKCEIKSKTSKRKIR

SEQ ID NO: 51833 - protein, 499 aa, Homo sapiens; identical to SEQ ID NO: 51832

SEQ ID NO: 51834 - protein, 1076 aa, Homo sapiens
MEPGSKSVSRSDWQPEPHQRPITPLEPGPEKTPIAQPESKTLQGSNTQQKPASNQRPLTQQETPAQHDAESQKEPRAQQKSASQEEFLAPQKPAPQQSPYIQRVLLTQQEAASQQGPGLGKESITQQEPALRQRHVAQPGPGPGEPPPAQQEAESTPAAQAKPGAKREPSAPTESTSQETPEQSDKQTTPVQGAKSKQGSLTELGFLTKLQELSIQRSALEWKALSEWVTDSESESDVGSSSDTDSPATMGGMVAQGVKLGFKGKSGYKVMSGYSGTSPHEKTSARNHRHYQDTASRLIHNMDLRTMTQSLVTLAEDNIAFFSSQGPGETAQRLSGVFAGVREQALGLEPALGRLLGVAHLFDLDPETPANGYRSLVHTARCCLAHLLHKSRYVASNRRSIFFRTSHNLAELEAYLAALTQLRALVYYAQRLLVTNRPGVLFFEGDEGLTADFLREYVTLHKGCFYGRCLGFQFTPAIRPFLQTISIGLVSFGEHYKRNETGLSVAASSLFTSGRFAIDPELRGAEFERITQNLDVHFWKAFWNITEMEVLSSLANMASATVRVSRLLSLPPEAFEMPLTADPTLTVTISPPLAHTGPGPVLVRLISYDLREGQDSEELSSLIKSNGQRSLELWPRPQQAPRSRSLIVHFHGGGFVAQTSRSHEPYLKSWAQELGAPIISIDYSLAPEAPFPRALEECFFAYCWAIKHCALLGSTGERICLAGDSAGGNLCFTVALRAAAYGVRVPDGIMAAYPATMLQPAASPSRLLSLMDPLLPLSVLSKCVSAYAGAKTEDHSNSDQKALGMMGLVRRDTALLLRDFRLGASSWLNSFLELSGRKSQKMSEPIAEPMRRSVSEAALAQPQGPLGTDSLKNLTLRDLSLRGNSETSSDTPEMSLSAETLSPSTPSDVNFLLPPEDAGEEAEAKNELSPMDRGLGVRAAFPEGFHPRRSSQGATQMPLYSSPIVKNPFMSPLLAPDSMLKSLPPVHIVACALDPMLDDSVMLARRLRNLGQPVTLRVVEDLPHGFLTLAALCRETRQAAELCVERIRLVLTPPAGAGPSGETGAAGVDGGCGGRH

SEQ ID NO: 51835 - protein, 451 aa, Homo sapiens
MLRFYLFISLLCLSRSDAEETCPSFTRLSFHSAVVGTGLNVRLMLYTRKNLTCAQTINSSAFGNLNVTKKTTFIVHGFRPTGSPPVWMDDLVKGLLSVEDMNVVVVDWNRGATTLIYTHASSKTRKVAMVLKEFIDQMLAEGASLDDIYMIGVSLGAHISGFVGEMYDGWLGRITGLDPAGPLFNGKPHQDRLDPSDAQFVDVIHSDTDALGYKEPLGNIDFYPNGGLDQPGCPKTILGGFQYFKCDHQRSVYLYLSSLRESCTITAYPCDSYQDYRNGKCVSCGTSQKESCPLLGYYADNWKDHLRGKDPPMTKAFFDTAEESPFCMYHYFVDIITWNKNVRRGDITIKLRDKAGNTTESKINHEPTTFQKYHQVSLLARFNQDLDKVAAISLMFSTGSLIGPRYKLRILRMKLRSLAHPERPQLCRYDLVLMENVETVFQPILCPELQL

SEQ ID NO: 51836 - protein, 481 aa, Homo sapiens
MLLKCLHNNLCQKYSAHAFQFSPRNVLWLLVVCLRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGLGIQEPLGHIDFYPNGGNKQPGCPKSIFSGIQFIKCNHQRAVHLFMASLETNCNFISFPCRSYKDYKTSLCVDCDCFKEKSCPRLGYQAKLFKGVLKERMEGRPLRTTVFLDTSGTYPFCTYYFVLSIIVPDKTMMDGSFSFKLLNQLGMIEEPRLYEKNKPFYKLQEVKILAQFYNDFVNISSIGLTYFQSSNLQCSTCTYKIQRLMLKSLTYPERPPLCRYNIVLKDREEVFLNPNTCTPKNT

SEQ ID NO: 51837 - protein, 156 aa, Homo sapiens
MNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGIQFIKCNHQRAVHLFMASLETNCNFISFPCRSYKDYKTSLCVDCDC

SEQ ID NO: 51838 - protein, 141 aa, Homo sapiens
  MOD_RES (1)..(1): Any amino acid
XYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGIQFIKCNHQRAVHLFMASLETNCNFISFPCRSYKDYKTSLCVDCDC

SEQ ID NO: 51839 - protein, 460 aa, Homo sapiens
MRVYIFLCLMCWVRSDNKRPCLEFSQLSVKDSFRDLFIPRIETILMMYTRNNLNCAEPLFEQNNSLNVNFNTQKKTVWLIHGYRPVGSIPLWLQNFVRILLNEEDMNVIVVDWSRGATTFIYNRAVKNTRKVAVSLSVHIKNLLKHGASLDNFHFIGVSLGAHISGFVGKIFHGQLGRITGLDPAGPRFSRKPPYSRLDYTDAKFVDVIHSDSNGLGIQEPLGHIDFYPNGGNKQPGCPKSIFSGIQFIKCNHQRAVHLFMASLETNCNFISFPCRSYKDYKTSLCVDCDCFKEKSCPRLGYQAKLFKGVLKERMEGRPLRTTVFLDTSGTYPFCTYYFVLSIIVPDKTMMDGSFSFKLLNQLGMIEEPRLYEKNKPFYKLQEVKILAQFYNDFVNISSIGLTYFQSSNLQCSTCTYKIQRLMLKSLTYPERPPLCRYNIVLKDREEVFLNPNTCTPKNT

SEQ ID NO: 51840 - protein, 890 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 51841 - protein, 620 aa, Homo sapiens
MLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 51842 - protein, 932 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSSLVDCKRTAPHLAVAAEGGLSSSCPPQSSLFHPSESPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 51843 - protein, 391 aa, Homo sapiens
MQAFQKPLPKSSCLSYLHVILDAIRFCFSKIFNAQIATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 51844 - protein, 28 aa, Homo sapiens
MNYVGQLAGQVFVTVKELYKGLNPATLS

SEQ ID NO: 51845 - protein, 896 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 51846 - protein, 96 aa, Homo sapiens
MNYVGQLAGQVFVTVKELYKGLNPATLSGCIDIIVIRQPNGNLQCSPFHVRFGKMGVLRSREKVVDIEINGESVDLHMKLGDNGEAFFVQETDNDQ

SEQ ID NO: 51847 - protein, 975 aa, Homo sapiens
MGEQDGIRSSSWETSQGKSSPDSAWSWIPIMRDPGWIRNVWSSNINVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSSLVDCKRTAPHLAVAAEGGLSSSCPPQSSLFHPSESPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKNGDPSGLAKHASDNGARSANQSPQSVGSSGVDSGVESTSDGLRDLPSIAISLCGGLSDHREITKDAFLEQAVSYQQFVDNPAIIDDPNLVVKIGSKYYNWTTAAPLLLAMQAFQKPLPKATVESIMRDKMPKKGGRWWFSWRGRNTTIKEESKPEQCLAGKAHSTGEQPPQLSLATRVKHESSSSDEERAAAKPSNAGHLPLLPNVSYKKTLRLTSEQLKSLKLKNGPNDVVFSVTTQYQGTCRCEGTIYLWNWDDKVIISDIDGTITRSDTLGHILPTLGKDWTHQGIAKLYHKVSQNGYKFLYCSARAIGMADMTRGYLHWVNERGTVLPQGPLLLSPSSLFSALHREVIEKKPEKFKVQCLTDIKNLFFPNTEPFYAAFGNRPADVYSYKQVGVSLNRIFTVNPKGELVQEHAKTNISSYVRLCEVVDHVFPLLKRSHSSDFPCSDTFSNFTFWREPLPPFENQDIHSASA

SEQ ID NO: 51848 - protein, 459 aa, Homo sapiens
MSRVQTMNYVGQLAGQVFVTVKELYKGLNPATLSGCIDIIVIRQPNGNLQCSPFHVRFGKMGVLRSREKVVDIEINGESVDLHMKLGDNGEAFFVQETDNDQEVIPMHLATSPILSEGASRMECQLKRGSVDRMRGLDPSTPAQVIAPSETPSSSSVVKKRRKRRRKSQLDSLKRDDNMNTSEDEDMFPIEMSSDEAMELLESSRTLPNDIPPFQDDIPEENLSLAVIYPQSASYPNSDREWSPTPSSLVDCKRTAPHLAVAAEGGLSSSCPPQSSLFHPSESPSGSRPSTPKSDSELVSKSTERTGQKNPEMLWLWGELPQAAKSSSPHKMKESSPLSSRKICDKSHFQAIHSESSDTFSDQSPTLVGGALLDQNKPQTEMQFVNEEDLETLGAAAPLLPMIEELKPPSASVVQTANKTDSPSRKRDKRSRHLGADGVYLDDLTDMDPEVAALYFPKK

SEQ ID NO: 51849 - protein, 896 aa, Homo sapiens
MNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLETTYPQTACPKSDSELEVKPAESLLRSESHMEWTWGGFPESTKVSKRERSDHHPRTATITPSENTHFRVIPSEDNLISEVEKDASMEDTVCTIVKPKPRALGTQMSDPTSVAELLEPPLESTQISSMLDADHLPNAALAEAPSESKPAAKVDSPSKKKGVHKRSQHQGPDDIYLDDLKGLEPEVAALYFPKSESEPGSRQWPESDTLSGSQSPQSVGSAAADSGTECLSDSAMDLPDVTLSLCGGLSENGEISKEKFMEHIITYHEFAENPGLIDNPNLVIRIYNRYYNWALAAPMILSLQVFQKSLPKATVESWVKDKMPKKSGRWWFWRKRESMTKQLPESKEGKSEAPPASDLPSSSKEPAGARPAENDSSSDEGSQELEESITVDPIPTEPLSHGSTTSYKKSLRLSSDQIAKLKLHDGPNDVVFSITTQYQGTCRCAGTIYLWNWNDKIIISDIDGTITKSDALGQILPQLGKDWTHQGIAKLYHSINENGYKFLYCSARAIGMADMTRGYLHWVNDKGTILPRGPLMLSPSSLFSAFHREVIEKKPEKFKIECLNDIKNLFAPSKQPFYAAFGNRPNDVYAYTQVGVPDCRIFTVNPKGELIQERTKGNKSSYHRLSELVEHVFPLLSKEQNSAFPCPEFSSFCYWRDPIPEVDLDDLS

SEQ ID NO: 51850 - protein, 233 aa, Homo sapiens
MNYVGQLAGQVIVTVKELYKGINQATLSGCIDVIVVQQQDGSYQCSPFHVRFGKLGVLRSKEKVIDIEINGSAVDLHMKLGDNGEAFFVEETEEEYEKLPAYLATSPIPTEDQFFKDIDTPLVKSGGDETPSQSSDISHVLETETIFTPSSVKKKKRRRKKYKQDSKKEEQAASAAAEDTCDVGVSSDDDKGAQAARGSSNASLKEEECKEPLLFHSGDHYPLSDGDWSPLET

SEQ ID NO: 51851 - protein, 851 aa, Homo sapiens
MNYVGQLAETVFGTVKELYRGLNPATLSGGIDVLVVKQVDGSFRCSPFHVRFGKLGVLRSREKVVDIELNGEPVDLHMKLGDSGEAFFVQELESDDEHVPPGLCTSPIPWGGLSGFPSDSQLGTASEPEGLVMAGTASTGRRKRRRRRKPKQKEDAVATDSSPEELEAGAESELSLPEKLRPEPPGVQLEEKSSLQPKDIYPYSDGEWPPQASLSAGELTSPKSDSELEVRTPEPSPLRAESHMQWAWGRLPKVARAERPESSVVLEGRAGATSPPRGGPSTPSTSVAGGVDPLGLPIQQTEAGADLQPDTEDPTLVGPPLHTPETEESKTQSSGDMGLPPASKSWSWATLEVPVPTGQPERVSRGKGSPKRSQHLGPSDIYLDDLPSLDSENAALYFPQSDSGLGARRWSEPSSQKSLRDPNPEHEPEPTLDTVDTIALSLCGGLADSRDISLEKFNQHSVSYQDLTKNPGLLDDPNLVVKINGKHYNWAVAAPMILSLQAFQKNLPKSTMDKLEREKMPRKGGRWWFSWRRRDFLAEERSAQKEKTAAKEQQGEKTEVLSSDDDAPDSPVILEIPSLPPSTPPSTPTYKKSLRLSSDQIRRLNLQEGANDVVFSVTTQYQGTCRCKATIYLWKWDDKVVISDIDGTITKSDALGHILPQLGKDWTHQGITSLYHKIQLNGYKFLYCSARAIGMADLTKGYLQWVSEGGCSLPKGPILLSPSSLFSALHREVIEKKPEVFKVACLSDIQQLFLPHGQPFYAAFGNRPNDVFAYRQVGLPESRIFTVNPRGELIQELIKNHKSTYERLGEVVELLFPPVARGPSTDLANPEYSNFCYWREPLPAVDLDTLD

SEQ ID NO: 51852 - protein, 413 aa, Homo sapiens
MGLPPASKSWSWATLEVPVPTGQPERVSRGKGSPKRSQHLGPSDIYLDDLPSLDSENAALYFPQSDSGLGARRWSEPSSQKSLRDPNPEHEPEPTLDTVDTIALSLCGGLADSRDISLEKFNQHSVSYQDLTKNPGLLDDPNLVVKINGKHYNWAVAAPMILSLQAFQKNLPKRSAQKEKTAAKEQQGEKTEVLSSDDDAPDSPVILEIPSLPPSTPPSTPTYKKSLRLSSDQIRRLNLQEGANDVVFSVTTQYQGTCRCKATIYLWKWDDKVVISDIDGTITKSDALGHILPQLGKDWTHQGITSLYHKIQLNGYKFLYCSARAIGMADLTKGYLQWVSEGGCSLPKGPILLSPSSLFSALHREVIEKKPEVFKVACLSDIQQLFLPHGQPFYAAFGNRPNDVFAYRQVGLP

SEQ ID NO: 51853 - protein, 270 aa, Homo sapiens
  MOD_RES (1)..(1): Any amino acid
XVKINGKHYNWAVAAPMILSLQAFQKNLPKRSAQKEKTAAKEQQGEKTEVLSSDDDAPDSPVILEIPSLPPSTPPSTPTYKKSLRLSSDQIRRLNLQEGANDVVFSVTTQYQGTCRCKATIYLWKWDDKVVISDIDGTITKSDALGHILPQLGKDWTHQGITSLYHKIQLNGYKFLYCSARAIGMADLTKGYLQWVSEGGCSLPKGPILLSPSSLFSALHREVIEKKPEVFKVACLSDIQQLFLPHGQPFYAAFGNRPNDVFAYRQVGLP

SEQ ID NO: 51854 - protein, 176 aa, Homo sapiens
MKPLLLAVSLGLIAALQAHHLLASDEEIQDVSGTWYLKAMTVDREFPEMNLESVTPMTLTTLEGGNLEAKVTMLISGRCQEVKAVLEKTDEPGKYTADGGKHVAYIIRSHVKDHYIFYCEGELHGKPVRGVKLVGRDPKNNLEALEDFEKAAGARGLSTESILIPRQSETCSPGSD

SEQ ID NO: 51855 - protein, 176 aa, Homo sapiens; identical to SEQ ID NO: 51854

SEQ ID NO: 51856 - protein, 187 aa, Homo sapiens
MRQGLLVLALVLVLVLVLAAGSQVQEWYPRESHALNWNKFSGFWYILATATDAQGFLPARDKRKLGASVVKVNKVGQLRVLLAFRRGQGCGRAQPRHPGTSGHLWASLSVKGVKAFHVLSTDYSYGLVYLRLGRATQNYKNLLLFHRQNVSSFQSLKEFMDACDILGLSKAAVILPKDASRTHTILP

SEQ ID NO: 51857 - protein, 200 aa, Homo sapiens
MRQGLLVLALVLVLVLVLAAGSQVQEWYPRESHALNWNKFSGFWYILATATDAQGFLPARDKRKLGASVVKVNKVGQLRVLLAFRRLKGCQSQEVILRKDGKKPVFGNACAYAAGPREGQEGVKGVKAFHVLSTDYSYGLVYLRLGRATQNYKNLLLFHRQNVSSFQSLKEFMDACDILGLSKAAVILPKDASRTHTILP

SEQ ID NO: 51858 - protein, 90 aa, Homo sapiens
TFELSDDGRFEVWNAMTRGQHCDTWSYVLIPAAQPGQFTVDHGVDTRAGWPSSGSACWAGAGCCLPGRWTSSSAWAELRASRMTTSSSQM

SEQ ID NO: 51859 - protein, 192 aa, Homo sapiens
MRLLCGLWLWLSLLKVLQAQTPTPLPLPPPMQSFQGNQFQGEWFVLGLAGNSFRPEHRALLNAFTATFELSDDGRFEVWNAMTRGQHCDTWSYVLIPAAQPGQFTVDHGVEPGADREETRVVDSDYTQFALMLSRRHTSRLAVLRISLLGRSWLLPPGTLDQFICLGRAQGLSDDNIVFPDVTGWSPQASVC

SEQ ID NO: 51860 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 51861 - protein, 200 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFREKAQKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 51862 - protein, 200 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRQWKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIDQCIDG

SEQ ID NO: 51863 - protein, 198 aa, Homo sapiens; identical to SEQ ID NO: 51860

SEQ ID NO: 51864 - protein, 198 aa, Homo sapiens
MPLGLLWLGLALLGALHAQAQDSTSDLIPAPPLSKVPLQQNFQDNQFQGKWYVVGLAGNAILREDKDPQKMYATIYELKEDKSYNVTSVLFRKKKCDYWIRTFVPGCQPGEFTLGNIKSYPGLTSYLVRVVSTNYNQHAMVFFKKVSQNREYFKITLYGRTKELTSELKENFIRFSKSLGLPENHIVFPVPIGNGQSG

SEQ ID NO: 51865 - protein, 163 aa, Homo sapiens
MGGLLLAAFLALVSVPRAQAVWLGRLDPEQLLGPWYVLAVASREKGFAMEKDMKNVVGVVVTLTPENNLRTLSSQHGLGGCDQSVMDLIKRNSGWVFENPSIGVLELWVLATNFRDYAIIFTQLEFGDEPFNTVELYSLTETASQEAMGLFTKWSRSLGFLSQ

SEQ ID NO: 51866 - protein, 152 aa, Homo sapiens
MEELDRQKIGGFWREVGVASDQSLVLTAPKRVEGLFLTLSGSNLTVKVAYNSSGSCEIEKIVGSEIDSTGKFAFPGHREIHVLDTDYEGYAILRVSLMWRGRNFRVLKYFTRSLEDKDRLGFWKFRELTADTGLYLAARPGRCAELLKEELI

SEQ ID NO: 51867 - protein, 176 aa, Homo sapiens
MALLLLSLGLSLIAAQEFDPHTVMQRNYNVARVSGVWYSIFMASDDLNRIKENGDLRVFVRNIEHLKNGSLIFDFEYMVQGECVAVVVVCEKTEKNGEYSINYEGQNTVAVSETDYRLFITFHLQNFRNGTETHTLALYETCEKYGLGSQNIIDLTNKDPCYSKHYRSPPRPPMRW

SEQ ID NO: 51868 - protein, 372 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVEEYITPEKFKYWEKVGNELGFHYTASGPLVRSSYKAGEFFLKNLVAKRKTKDL

SEQ ID NO: 51869 - protein, 322 aa, Homo sapiens
MSLRCGDAARTLGPRVFGRYFCSPVRPLSSLPDKKKELLQNGPDLQDFVSGDLADRSTWDEYKGNLKRQKGERLRLPPWLKTEIPMGKNYNKLKNTLRNLNLHTVCEEARCPNIGECWGGGEYATATATIMLMGDTCTRGCRFCSVKTARNPPPLDASEPYNTAKAIAEWGLDYVVLTSVDRDDMPDGGAEHIAKTVSYLKERNPKILVECLTPDFRGDLKAIEKVALSGLDVYAHNVETVPELQSKVRDPRANFDQSLRVLKHAKKVQPDVISKTSIMLGLGENDEQVYATMKALREADVDCLTLGQYMQPTRRHLKVNFS

SEQ ID NO: 51870 - protein, 200 aa, Homo sapiens
MASSLTCTGVIWALLSFLCAATSCVGFFMPYWLWGSQLGKPVSFGTFRRCSYPVHDESRQMMVMVEECGRYASFQGIPSAEWRICTIVTGLGCGLLLLVALTALMGCCVSDLISRTVGRVAGGIQFLGGLLIGAGCALYPLGWDSEEVRQTCGYTSGQFDLGKCEIGWAYYCTGAGATAAMLLCTWLACFSGKKQKHYPY

SEQ ID NO: 51871 - protein, 220 aa, Homo sapiens
MRSSLTMVGTLWAFLSLVTAVTSSTSYFLPYWLFGSQMGKPVSFSTFRRCNYPVRGEGHSLIMVEECGRYASFNAIPSLAWQMCTVVTGAGCALLLLVALAAVLGCCMEELISRMMGRCMGAAQFVGGLLISSGCALYPLGWNSPEIMQTCGNVSNQFQLGTCRLGWAYYCAGGGAAAAMLICTWLSCFAGRNPKPVILVESIMRNTNSYAMELDHCLKP

SEQ ID NO: 51872 - protein, 187 aa, Homo sapiens
MRSSLTMVGTLWAFLSLVTAVTSSTSYFLPYWLFGSQMGKPVSFSTFRRCNYPVRGEGHSLIMVEECGRYASFNAIPSLAWQMCTVVTGAGCALLLLVALAAVLGCCMEELISRMMGRCMGAAQFVGGTCRLGWAYYCAGGGAAAAMLICTWLSCFAGRNPKPVILVESIMRNTNSYAMELDHCLKP

SEQ ID NO: 51873 - protein, 228 aa, Homo sapiens
MCHVIVTCRSMLWTLLSIVVAFAELIAFMSADWLIGKARSRGGVEPAGPGGGSPEPYHPTLGIYARCIRNPGVQHFQRDTLCGPYAESFGEIASGFWQATAIFLAVGIFILCMVALVSVFTMCVQSIMKKSIFNVCGLLQGIAGLFLILGLILYPAGWGCQKAIDYCGHYASAYKPGDCSLGWAFYTAIGGTVLTFICAVFSAQAEIATSSDKVQEEIEEGKNLICLL

SEQ ID NO: 51874 - protein, 228 aa, Homo sapiens; identical to SEQ ID NO: 51873

SEQ ID NO: 51875 - protein, 222 aa, Homo sapiens
MLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSAACLVLGCMIFPDGWDSDEVKRMCGEKTDKYTLGACSVRWAYILAIIGILDALILSFLAFVLGNRQDSLMAEELKAENKVLLSQYSLE

SEQ ID NO: 51876 - protein, 236 aa, Homo sapiens
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSGDCLVLFDLHFPDGWDSDEVKRMCGEKTDKYTLGACSVRWAYILAIIGILDALILSFLAFVLGNRQDSLMAEELKAENKVLLSQYSLE

SEQ ID NO: 51877 - protein, 232 aa, Homo sapiens
MPGAAAAAAAAAAAMLPAQEAAKLYHTNYVRNSRAIGVLWAIFTICFAIVNVVCFIQPYWIGDGVDTPQAGYFGLFHYCIGNGFSRELTCRGSFTDFSTLPSGAFKAASFFIGLSMMLIIACIICFTLFFFCNTATVYKICAWMQLTSGDCLVLFDLHFPDGWDSDEVKRMCGEKTDKYTLGACSVRWAYILAIIGILDALILSFLAFVLGNRQDSLMAEELKAENKDDGNA

SEQ ID NO: 51878 - protein, 219 aa, Homo sapiens
MVKLLPAQEAAKIYHTNYVRNSRAVGVMWGTLTICFSVLVMALFIQPYWIGDSVNTPQAGYFGLFSYCVGNVLSSELICKGGPLDFSSIPSRAFKTAMFFVALGMFLIIGSIICFSLFFICNTATVYKICAWMQLAAATGLMIGCLVYPDGWDSSEVRRMCGEQTGKYTLGHCTIRWAFMLAILSIGDALILSFLAFVLGYRQDKLLPDDYKADGTEEV

SEQ ID NO: 51879 - protein, 219 aa, Homo sapiens; identical to SEQ ID NO: 51878

SEQ ID NO: 51880 - protein, 481 aa, Homo sapiens
MGALARALPSILLALLLTSTPEALGANPGLVARITDKGLQYAAQEGLLALQSELLRITLPDFTGDLRIPHVGRGRYEFHSLNIHSCELLHSALRPVPGQGLSLSISDSSIRVQGRWKVRKSFFKLQGSFDVSVKGISISVNLLLGSESSGRPTVTASSCSSDIADVEVDMSGDLGWLLNLFHNQIESKFQKVLESRICEMIQKSVSSDLQPYLQTLPVTTEIDSFADIDYSLVEAPRATAQMLEVMFKGEIFHRNHRSPVTLLAAVMSLPEEHNKMVYFAISDYVFNTASLVYHEEGYLNFSITDDMIPPDSNIRLTTKSFRPFVPRLARLYPNMNLELQGSVPSAPLLNFSPGNLSVDPYMEIDAFVLLPSSSKEPVFRLSVATNVSATLTFNTSKITGFLKPGKVKVELKESKVGLFNAELLEALLNYYILNTFYPKFNDKLAEGFPLPLLKRVQLYDLGLQIHKDFLFLGANVQYMRV

SEQ ID NO: 51881 - protein, 477 aa, Homo sapiens [sequence omitted]

SEQ ID NO: 51882 - protein, 161 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGCIAGCCFIPFCVDALQDVDHYCPNCRALLGTYKRL

SEQ ID NO: 51883 - protein, 228 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGVHSGLLLHPLLRGCPAGRGPLLSQLQSSPGHLQAFVGLSQTWREPGAAGSPFHLSSSFTPGGGSALVVSPLQGAHLHVFFWGEYVAKLTNLQTPEIAAWSRA

SEQ ID NO: 51884 - protein, 152 aa, Homo sapiens
MSVPGPYQAATGPSSAPSAPPSYEETVAVNSYYPTPPAPMPGPTTGLVTGPDGKGMNPPSYYTQPAPIPNNNPITVQTVYVQHPITFLDRPIQMCCPSCNKMIVSQLSYNAGALTWLSCGSLCLLGQECSGTIVALRSFDLLGSCNPPSSAS

SEQ ID NO: 51885 - protein, 161 aa, Homo sapiens; identical to SEQ ID NO: 51882

SEQ ID NO: 51886 - protein, 2040 aa, Homo sapiens
MEHKEVVLLLLLFLKSAAPEQSHVVQDCYHGDGQSYRGTYSTTVTGRTCQAWSSMTPHQHNRTTENYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDAVAAPYCYTRDPGVRWEYCNLTQCSDAEGTAVAPPTVTPVPSLEAPSEQAPTEQRPGVQECYHGNGQSYRGTYSTTVTGRTCQAWSSMTPHSHSRTPEYYPNAGLIMNYCRNPDPVAAPYCYTRDPSVRWEYCNLTQCSDAEGTAVAPPTITPIPSLEAPSEQAPTEQRPGVQECYHGNGQSYQGTYFITVTGRTCQAWSSMTPHSHSRTPAYYPNAGLIKNYCRNPDPVAAPWCYTTDPSVRWEYCNLTRCSDAEWTAFVPPNVILAPSLEAFFEQALTEETPGVQDCYYHYGQSYRGTYSTTVTGRTCQAWSSMTPHQHSRTPENYPNAGLTRNYCRNPDAEIRPWCYTMDPSVRWEYCNLTQCLVTESSVLATLTVVPDPSTEASSEEAPTEQSPGVQDCYHGDGQSYRGSFSTTVTGRTCQSWSSMTPHWHQRTTEYYPNGGLTRNYCRNPDAEISPWCYTMDPNVRWEYCNLTQCPVTESSVLATSTAVSEQAPTEQSPTVQDCYHGDGQSYRGSFSTTVTGRTCQSWSSMTPHWHQRTTEYYPNGGLTRNYCRNPDAEIRPWCYTMDPSVRWEYCNLTQCPVMESTLLTTPTVVPVPSTELPSEEAPTENSTGVQDCYRGDGQSYRGTLSTTITGRTCQSWSSMTPHWHRRIPLYYPNAGLTRNYCRNPDAEIRPWCYTMDPSVRWEYCNLTRCPVTESSVLTTPTVAPVPSTEAPSEQAPPEKSPVVQDCYHGDGRSYRGISSTTVTGRTCQSWSSMIPHWHQRTPENYPNAGLTENYCRNPDSGKQPWCYTTDPCVRWEYCNLTQCSETESGVLETPTVVPVPSMEAHSEAAPTEQTPVVRQCYHGNGQSYRGTFSTTVTGRTCQSWSSMTPHRHQRTPENYPNDGLTMNYCRNPDADTGPWCFTMDPSIRWEYCNLTRCSDTEGTVVAPPTVIQVPSLGPPSEQDCMFGNGKGYRGKKATTVTGTPCQEWAAQEPHRHSTFIPGTNKWAGLEKNYCRNPDGDINGPWCYTMNPRKLFDYCDIPLCASSSFDCGKPQVEPKKCPGSIVGGCVAHPHSWPWQVSLRTRFGKHFCGGTLISPEWVLTAAHCLKKSSRPSSYKVILGAHQEVNLESHVQEIEVSRLFLEPTQADIALLKLSRPAVITDKVMPACLPSPDYMVTARTECYITGWGETQGTFGTGLLKEAQLLVIENEVCNHYKYICAEHLARGTDSCQGDSGGPLVCFEKDKYILQGVTSWGLGCARPNKPGVYARVSRFVTWIEGMMRNN

SEQ ID NO: 51887 - protein, 2040 aa, Homo sapiens; identical to SEQ ID NO: 51886

SEQ ID NO: 51888 - protein, 1533 aa, Homo sapiens
MMQLTLNTLFPVVSTPAITYIVTVFTGDVRGAGTKSKIYLVMYGARGNKNSGKIFLEGGVFDRGRTDIFHIELAVLLSPLSRVSVGHGNVGVNRGWFCEKVVILCPFTGIQQTFPCSNWLDEKKADGLIERQLYEMVSLRKKRLKKFPWSLWVWTTDLKKAGTNSPIFIQIYGQKGRTDEILLNPNNKWFKPGIIEKFRIELPDLGRFYKIRVWHDKRSSGSGWHLERMTLMNTLNKDKYNFNCNRWLDANEDDNEIVREMTAEGPTVRRIMGMARYHVTVCTGELEGAGTDANVYLCLFGDVGDTGERLLYNCRNNTDLFEKGNADEFTIESVTMRNVRRVRIRHDGKGSGSGWYLDRVLVREEGQPESDNVEFPCLRWLDKDKDDGQLVRELLPSDSSATLKNFRYHISLKTGDVSGASTDSRVYIKLYGDKSDTIKQVLLVSDNNLKDYFERGRVDEFTLETLNIGNINRLVIGHDSTGMHASWFLGSVQIRVPRQGKQYTFPANRWLDKNQADGRLEVELYPSEVVEIQKLVHYEVEIWTGDVGGAGTSARVYMQIYGEKGKTEVLFLSSRSKVFERASKDTFQLEAADVGEVYKLRLGHTGEGFGPSWFVDTVWLRHLVVREVDLTPEEEARKKKEKDKLRQLLKKERLKAKLQRKKKKRKGSDEEDEGEEEESSSSEESSSEEEEMEEEEEEEEFGPGMQEVIEQHKFEAHRWLARGKEDNELVVELVPAGKPGPERNTYEVQVVTGNVPKAGTDANVYLTIYGEEYGDTGERPLKKSDKSNKFEQGQTDTFTIYAIDLGALTKIRIRHDNTGNRAGWFLDRIDITDMNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIEVLYEMTVWTGDVVGGGTDSNIFMTLYGINGSTEEMQLDKKKARFEREQNDTFIMEILDIAPFTKMRIRIDGLGSRPEWFLERVKCLDPHSSFQPPPTPSPGSSGLSMDLVKAQMSL

SEQ ID NO: 51889 - protein, 1947 aa, Homo sapiens
MMQLTLNTLFPVVSTPAITYIVTVFTGDVRGAGTKSKIYLVMYGARGNKNSGKIFLEGGVFDRGRTDIFHIELAVLLSPLSRVSVGHGNVGVNRGWFCEKVVILCPFTGIQQTFPCSNWLDEKKADGLIERQLYEMVSLRKKRLKKFPWSLWVWTTDLKKAGTNSPIFIQIYGQKGRTDEILLNPNNKWFKPGIIEKFRIELPDLGRFYKIRVWHDKRSSGSGWHLERMTLMNTLNKDKYNFNCNRWLDANEDDNEIVREMTAEGPTVRRIMGMARYHVTVCTGELEGAGTDANVYLCLFGDVGDTGERLLYNCRNNTDLFEKGNADEFTIESVTMRNVRRVRIRHDGKGSGSGWYLDRVLVREEGQPESDNVEFPCLRWLDKDKDDGQLVRELLPSDSSATLKNFRYHISLKTGDVSGASTDSRVYIKLYGDKSDTIKQVLLVSDNNLKDYFERGRVDEFTLETLNIGNINRLVIGHDSTGMHASWFLGSVQIRVPRQGKQYTFPANRWLDKNQADGRLEVELYPSEVVEIQKLVHYEVEIWTGDVGGAGTSARVYMQIYGEKGKTEVLFLSSRSKVFERASKDTFQLEAADVGEVYKLRLGHTGEGFGPSWFVDTVWLRHLVVREVDLTPEEEARKKKEKDKLRQLLKKERLKAKLQRKKKKRKGSDEEDEGEEEESSSSEESSSEEEEMEEEEEEEEFGPGMQEVIEQHKFEAHRWLARGKEDNELVVELVPAGKPGPERNTYEVQVVTGNVPKAGTDANVYLTIYGEEYGDTGERPLKKSDKSNKFEQGQTDTFTIYAIDLGALTKIRIRHDNTGNRAGWFLDRIDITDMNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIELGHDGASPESCWLVEELCLAVPTQGTKYMLNCNCWLAKDRGDGITSRVFDLLDAMVVNIGVKVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELVVTRLGLAAECG

SEQ ID NO: 51890 - protein, 1144 aa, Homo sapiens
MLRHLTDTFTIYAIDLGALTKIRIRHDNTGNRAGWFLDRIDITDMNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIEVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRKVRLEHDSSGYCSGWLVEKVEVTNTSTGVATIFNCGRWLDKKRGDGLTWRDLFPSV

SEQ ID NO: 51891 - protein, 306 aa, Homo sapiens
MRLGTNCEHPQLPLAAPSGYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKD

SEQ ID NO: 51892 - protein, 2211 aa, Homo sapiens
MMPQKKRRRKKDIDFLALYEAELLNYASEDDEGELEHEYYKARVYEVVTATGDVRGAGTDANVFITLFGENGLSPKLQLTSKSKSAFEKGNVDVFRVRTNNVGLIYKVRIEHDNTGLNASWYLDHVIVTDMKRPHLRYYFNCNNWLSKVEGDRQWCRDLLASFNPMDMPRGNKYEVKVYTGDVIGAGTDADVFINIFGEYGDTGERRLENEKDNFEKGAEDRFILDAPDLGQLMKINVGHNNKGGSAGWFLSQIVIEDIGNKRKYDFPLNRWLALDEDDGKIQRDILVGGAETTAITYIVTVFTGDVRGAGTKSKIYLVMYGARGNKNSGKIFLEGGVFDRGRTDIFHIELAVLLSPLSRVSVGHGNVGVNRGWFCEKVVILCPFTGIQQTFPCSNWLDEKKADGLIERQLYEMVSLRKKRLKKFPWSLWVWTTDLKKAGTNSPIFIQIYGQKGRTDEILLNPNNKWFKPGIIEKFRIELPDLGRFYKIRVWHDKRSSGSGWHLERMTLMNTLNKDKYNFNCNRWLDANEDDNEIVREMTAEGPTVRRIMGMARYHVTVCTGELEGAGTDANVYLCLFGDVGDTGERLLYNCRNNTDLFEKGNADEFTIESVTMRNVRRVRIRHDGKGSGSGWYLDRVLVREEGQPESDNVEFPCLRWLDKDKDDGQLVRELLPSDSSATLKNFRYHISLKTGDVSGASTDSRVYIKLYGDKSDTIKQVLLVSDNNLKDYFERGRVDEFTLETLNIGNINRLVIGHDSTGMHASWFLGSVQIRVPRQGKQYTFPANRWLDKNQADGRLEVELYPSEVVEIQKLVHYEVEIWTGDVGGAGTSARVYMQIYGEKGKTEVLFLSSRSKVFERASKDTFQLEAADVGEVYKLRLGHTGEGFGPSWFVDTVWLRHLVVREVDLTPEEEARKKKEKDKLRQLLKKERLKAKLQRKKKKRKGSDEEDEGEEEESSSSEESSSEEEEMEEEEEEEEFGPGMQEVIEQHKFEAHRWLARGKEDNELVVELVPAGKPGPERNTYEVQVVTGNVPKAGTDANVYLTIYGEEYGDTGERPLKKSDKSNKFEQGQTDTFTIYAIDLGALTKIRIRHDNTGNRAGWFLDRIDITDMNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIEVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRKVRLEHDSSGYCSGWLVEKVEVTNTSTGVATIFNCGRWLDKKRGDGLTWRDLFPSV

SEQ ID NO: 51893 - protein, 1114 aa, Homo sapiens
MNNEITYYFPCQRWLAVEEDDGQLSRELLPVDESYVLPQSEEGRGGGDNNPLDNLALEQKDKSTTFSVTIKTGVKKNAGTDANVFITLFGTQDDTGMTLLKSSKTNSDKFERDSIEIFTVETLDLGDLWKVRLGHDNTGKAPGWFVDWVEVDAPSLGKCMTFPCGRWLAKNEDDGSIIRDLFHAELQTRLYTPFVPYEITLYTSDVFAAGTDANIFIIIYGCDAVCTQQKYLCTNKREQKQFFERKSASRFIVELEDVGEIIEKIRIGHNNTGMNPGWHCSHVDIRRLLPDKDGAETLTFPCDRWLATSEDDKKTIRELVPYDIFTEKYMKDGSLRQVYKEVEEPLDIVLYSVQIFTGNIPGAGTDAKVYITIYGDLGDTGERYLGKSENRTNKFERGTADTFIIEAADLGVIYKIKLRHDNSKWCADWYVEKVEIWNDTNEDEFLFLCGRWLSLKKEDGRLERLFYEKEYTGDRSSNCSSPADFWEIALSSKMADVDISTVTGPMADYVQEGPIIPYYVSVTTGKHKDAATDSRAFIFLIGEDDERSKRIWLDYPRGKRGFSRGSVEEFYVAGLDVGIIKKIELGHDGASPESCWLVEELCLAVPTQGTKYMLNCNCWLAKDRGDGITSRVFDLLDAMVVNIGVKVLYEMTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELVVTRLGLAAECG

SEQ ID NO: 51894 - protein, 512 aa, Homo sapiens
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRKVRLEHDSSGYCSGWLVEKVEVTNTSTGVATIFNCGRWLDKKRGDGLTWRDLFPSV

SEQ ID NO: 51895 - protein, 457 aa, Homo sapiens
MTVWTGDVVGGGTDSNIFMTLYGINGSTEEMQLDKKKARFEREQNDTFIMEILDIAPFTKMRIRIDGLGSRPEWFLERILLKNMNTGDLTMFYYGDWLSQRKGKKTLVCEMCAVIDEEEMMEWTSYTVAVKTSDILGAGTDANVFIIIFGENGDSGTLALKQSANWNKFERNNTDTFNFPDMLSLGHLCKLRVWHDNKGIFPGWHLSYVDVKDNSRDETFHFQCDCWLSKSEGDGQTVRDFACANNKICDELEETTYEIVIETGNGGETRENVWLILEGRKNRSKEFLMENSSRQRAFRKGTTDTFEFDSIYLGDIASLCVGHLAREDRFIPKRELAWHVKTITITEMEYGNVYFFNCDCLIPLKRKRKYFKVFEVTKTTESFASKVQSLVPVKYEVIVTTGYEPGAGTDANVFVTIFGANGDTGKRELKQKMRNLFERGSTDRFFLETLELGELRK

SEQ ID NO: 51896 - protein, 373 aa, Homo sapiens
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPTDETLFPGINSKAKELQTWEWIYGKTPKFSINTSFHVLYEQSHLEIKVFIDIKNGRIEICNIEAPDHWLPLEIRDKLNSSLIGSKFCPTETTMLTNILLRTCPQDHKLNSKWNILCEKIKGIM

SEQ ID NO: 51897 - protein, 373 aa, Homo sapiens; identical to SEQ ID NO: 51896

SEQ ID NO: 51898 - protein, 373 aa, Homo sapiens; identical to SEQ ID NO: 51896

SEQ ID NO: 51899 - protein, 373 aa, Homo sapiens; identical to SEQ ID NO: 51896

SEQ ID NO: 51900 - protein, 373 aa, Homo sapiens; identical to SEQ ID NO: 51896

SEQ ID NO: 51901 - protein, 106 aa, Homo sapiens
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTV

SEQ ID NO: 51902 - protein, 251 aa, Homo sapiens
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPT

SEQ ID NO: 51903 - protein, 39 aa, Homo sapiens
MLIPFSMKNCFQLLCNCQVPAAGFKKTVKNGLILQSISN

SEQ ID NO: 51904 - protein, 135 aa, Homo sapiens
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVR

SEQ ID NO: 51905 - protein, 1766 aa, Homo sapiens
MGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNGGFGHLAIFNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGENKDVSETSFQNAMLKPMCETLTYISKEQLLSHKLPARLVADQKTNLPEYLQTLLNTLAPLLLFRARPVQIAVYHMLYKLMPELPQYDQDNLKSYGDEEEEPALSPPAALMSLLSIQEDLLENVLGCIPVGQIVTIKPLSEDFCYVLGYLLTWKLILTFFKAASSQLRALYSMYLRKTKSLNKLLYHLFRLMPENPTYAETAVEVPNKDPKTFFTEELQLSIRETTMLPYHIPHLACSVYHMTLKDLPAMVRLWWNSSEKRVFNIVDRFTSKYVSSVLSFQEISSVQTSTQLFNGMTVKARATTREVMATYTIEDIVIELIIQLPSNYPLGSIIVESGKRVGVAVQQWRNWMLQLSTYLTHQNGSIMEGLALWKNNVDKRFEGVEDCMICFSVIHGFNYSLPKKACRTCKKKFHSACLYKWFTSSNKSTCPLCRETFF

SEQ ID NO: 51906 - protein, 480 aa, Homo sapiens
MGGKNKQRTKGNLRPSNSGRAAELLAKEQGTVPGFIGFGTSQSDLGYVPAIQGAEEIDSLVDSDFRMVLRKLSKKDVTTKLKANAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEK

SEQ ID NO: 51907 - protein, 1812 aa, Homo sapiens
MDRVGGGKGPGGSYYRVSSSAARSRKLCPGRVNRGLSAQSTAATATMGGKNKQRTKGNLRPSNSGRAAELLAKEQGTVPGFIGFGTSQSDLGYVPAIQGAEEIDSLVDSDFRMVLRKLSKKDVTTKLKAMQEFGTMCTERDTETVKGVLPYWPRIFCKISLDHDRRVREATQQAFEKLILKVKKQLAPYLKSLMGYWLMAQCDTYTPAAFAAKDAFEAAFPPSKQPEAIAFCKDEITSVLQDHLIKETPDTLSDPQTVPEEEREAKFYRVVTCSLLALKRLLCLLPDNELDSLEEKFKSLLSQNKFWKYGKHSVPQIRSAYFELVSALCQRIPQLMKEEASKVSPSVLLSIDDSDPIVCPALWEAVLYTLTTIEDCWLHVNAKKSVFPKLSTVIREGGRGLATVIYPYLLPFISKLPQSITNPKLDFFKNFLTSLVAGLSTERTKTSSLESSAVISAFFECLRFIMQQNLGEEEIEQMLVNDQLIPFIDAVLKDPGLQHGQLFNHLAETLSSWEAKADTEKDEKTAHNLENVLIHFWERLSEICVAKISEPEADVESVLGVSNLLQVLQKPKSSLKSSKKKNGKVRFADEILESNKENEKCVSSEGEKIEGWELTTEPSLTHNSSGLLSPLRKKPLEDLVCKLADISINYVNERKSEQHLRFLSTLLDSFSSSRVFKMLLGDEKQSIVQAKPLEIAKLVQKNPAVQFLYQKLIGWLNEDQRKDFGFLVDILYSALRCCDNDMERKKVLDDLTKVDLKWNSLLKIIEKACPSSDKHALVTPWLKGDILGEKLVNLADCLCNEDLESRVSSESHFSERWTLLSLVLSQHVKNDYLIGDVYVERIIVRLHETLFKTKKLSEAESSDSSVSFICDVAYNYFSSAKGCLLMPSSEDLLLTLFQLCAQSKEKTHLPDFLICKLKNTWLSGVNLLVHQTDSSYKESTFLHLSALWLKNQVQASSLDINSLQVLLSAVDDLLNTLLESEDSYLMGVYIGSVMPNDSEWEKMRQSLPMQWLHRPLLEGRLSLNYECFKTDFKEQDIKTLPSHLCTSALLSKMVLIALRKETVLENNELEKIIAELLYSLQWCEELDNPPIFLIGFCEILQKMNITYDNLRVLGNTSGLLQLLFNRSREHGTLWSLIIAKLILSRSISSDEVKPHYKRKESFFPLTEGNLHTIQSLCPFLSKEEKKEFSAQCIPALLGWTKKDLCSTNGGFGHLAIFNSCLQTKSIDDGELLHGILKIIISWKKEHEDIFLFSCNLSEASPEVLGVNIEIIRFLSLFLKYCSSPLAESEWDFIMCSMLAWLETTSENQALYSIPLVQLFACVSCDLACDLSAFFDSTTLDTIGNLPVNLISEWKEFFSQGIHSLLLPILVTVTGENKDVSETSFQNAMLKPMCETLTYISKEQLLSHKLPARLVADQKTNLPEYLQTLLNTLAPLLLFRARPVQIAVYHMLYKLMPELPQYDQDNLKSYGDEEEEPALSPPAALMSLLSIQEDLLENVLGCIPVGQIVTIKPLSEDFCYVLGYLLTWKLILTFFKAASSQLRALYSMYLRKTKSLNKLLYHLFRLMPENPTYAETAVEVPNKDPKTFFTEELQLSIRETTMLPYHIPHLACSVYHMTLKDLPAMVRLWWNSSEKRVFNIVDRFTSKYVSSVLSFQEISSVQTSTQLFNGMTVKARATTREVMATYTIEDIVIELIIQLPSNYPLGSIIVESGKRVGVAVQQWRNWMLQLSTYLTHQNGSIMEGLALWKNNVDKRFEGVEDCMICFSVIHGFNYSLPKKACRTCKKKFHSACLYKWFTSSNKSTCPLCRETFF

SEQ ID NO: 51908 - protein, 467 aa, Homo sapiens
MKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 51909 - protein, 540 aa, Homo sapiens
MATSGAASAELVIGWCIFGLLLLAILAFCWIYVRKYQSRRESEVVSTITAIFSLAIALITSALLPVDIFLVSYMKNQNGTFKDWANANVSRQIEDTVLYGYYTLYSVILFCVFFWIPFVYFYYEEKDDDDTSKCTQIKTALKYTLGFVVICALLLLVGAFVPLNVPNNKNSTEWEKVKSLFEELGSSHGLAALSFSISSLTLIGMLAAITYTAYGMSALPLNLIKGTRSAAYERLENTEDIEEVEQHIQTIKSKSKDGRPLPARDKRALKQFEERLRTLKKRERHLEFIENSWWTKFCGALRPLKIVWGIFFILVALLFVISLFLSNLDKALHSAGIDSGFIIFGANLSNPLNMLLPLLQTVFPLDYILITIIIMYFIFTSMAGIRNIGIWFFWIRLYKIRRGRTRPQALLFLCMILLLIVLHTSYMIYSLAPQYVMYGSQNYLIETNITSDNHKGNSTLSVPKRCDADAPEDQCTVTRTYLFLHKFWFFSAAYYFGNWAFLGVFLIGLIVSCCKGKKSVIEGVDEDSDISDDEPSVYSA

SEQ ID NO: 51910 - protein, 312 aa, Homo sapiens
MSYQKKQPTPQPPVDCVKTSGGGGGGGGSGGGGCGFFGGGGSGGGSSGSGCGYSGGGGYSGGGCGGGSSGGGGGGGIGGCGGGSGGSVKYSGGGGSSGGGSGCFSSGGGGSGCFSSGGGGSSGGGSGCFSSGGGGSSGGGSGCFSSGGGGFSGQAVQCQSYGGVSSGGSSGGGSGCFSSGGGGGSVCGYSGGGSGCGGGSSGGSGSGYVSSQQVTQTSCAPQPSYGGGSSGGGGSGGSGCFSSGGGGGSSGCGGGSSGIGSGCIISGGGSVCGGGSSGGGGGGSSVGGSGSGKGVPICHQTQQKQAPTWPSK

SEQ ID NO: 51911 - protein, 333 aa, Homo sapiens
MSYQKKQPTPQPPVDCVKTSGGGGGGGGSGGGGCGFFGGGGSGGGSSGSGCGYSGGGGYSGGGCGGGSSGGGGGGGIGGCGGGSGGSVKYSGGGGSSGGGSGCFSSGGGGSGCFSSGGGGSSGGGSGCFSSGGGGSSGGGSGCFSSGGGGFSGQAVQCQSYGGVSSGGSSGGGSGCFSSGGGGGSVCGYSGGGSGCGGGSSGGSGSGYVSSQQVTQTSCAPQPSYGGGVRRRRQRRKRLLLQRRGRRELRLRRRLLRDWQRLHHQWRGLRLRRWFLWRRRRRLLRGWLREWQGRPDLPPDPAEAGAYLAVQIDPPGYHGGEGVGGVFQGHRWA

SEQ ID NO: 51912 - protein, 308 aa, Homo sapiens
MDALKSAGRALIRSPSLAKQSWGGGGRHRKLPENWTDTRETLLEGMLFSLKYLGMTLVEQPKGEELSAAAIKRIVATAKASGKKLQKVTLKVSPRGIILTDNLTNQLIENVSIYRISYCTADKMHDKVFAYIAQSQHNQSLECHAFLCTKRKMAQAVTLTVAQAFKVAFEFWQVSKEEKEKRDKASQEGGDVLGARQDCTPSLKSLVATGNLLDLEETAKAPLSTVSANTTNMDEVPRPQALSGSSVVWELDDGLDEAFSRLAQSRTNPQVLDTGLTAQDMHYAQCLSPVDWDKPDSSGTEQDDLFSF

SEQ ID NO: 51913 - protein, 269 aa, Homo sapiens; identical to SEQ ID NO: 41436

SEQ ID NO: 51914 - protein, 4544 aa, Homo sapiens
MLTPPLLLLLPLLSALVAAAIDAPKTCSPKQFACRDQITCISKGWRCDGERDCPDGSDEAPEICPQSKAQRCQPNEHNCLGTELCVPMSRLCNGVQDCMDGSDEGPHCRELQGNCSRLGCQHHCVPTLDGPTCYCNSSFQLQADGKTCKDFDECSVYGTCSQLCTNTDGSFICGCVEGYLLQPDNRSCKAKNEPVDRPPVLLIANSQNILATYLSGAQVSTITPTSTRQTTAMDFSYANETVCWVHVGDSAAQTQLKCARMPGLKGFVDEHTINISLSLHHVEQMAIDWLTGNFYFVDDIDDRIFVCNRNGDTCVTLLDLELYNPKGIALDPAMGKVFFTDYGQIPKVERCDMDGQNRTKLVDSKIVFPHGITLDLVSRLVYWADAYLDYIEVVDYEGKGRQTIIQGILIEHLYGLTVFENYLYATNSDNANAQQKTSVIRVNRFNSTEYQVVTRVDKGGALHIYHQRRQPRVRSHACENDQYGKPGGCSDICLLANSHKARTCRCRSGFSLGSDGKSCKKPEHELFLVYGKGRPGIIRGMDMGAKVPDEHMIPIENLMNPRALDFHAETGFIYFADTTSYLIGRQKIDGTERETILKDGIHNVEGVAVDWMGDNLYWTDDGPKKTISVARLEKAAQTRKTLIEGKMTHPRAIVVDPLNGWMYWTDWEEDPKDSRRGRLERAWMDGSHRDIFVTSKTVLWPNGLSLDIPAGRLYWVDAFYDRIETILLNGTDRKIVYEGPELNHAFGLCHHGNYLFWTEYRSGSVYRLERGVGGAPPTVTLLRSERPPIFEIRMYDAQQQQVGTNKCRVNNGGCSSLCLATPGSRQCACAEDQVLDADGVTCLANPSYVPPPQCQPGEFACANSRCIQERWKCDGDNDCLDNSDEAPALCHQHTCPSDRFKCENNRCIPNRWLCDGDNDCGNSEDESNATCSARTCPPNQFSCASGRCIPISWTCDLDDDCGDRSDESASCAYPTCFPLTQFTCNNGRCININWRCDNDNDCGDNSDEAGCSHSCSSTQFKCNSGRCIPEHWTCDGDNDCGDYSDETHANCTNQATRPPGGCHTDEFQCRLDGLCIPLRWRCDGDTDCMDSSDEKSCEGVTHVCDPSVKFGCKDSARCISKAWVCDGDNDCEDNSDEENCESLACRPPSHPCANNTSVCLPPDKLCDGNDDCGDGSDEGELCDQCSLNNGGCSHNCSVAPGEGIVCSCPLGMELGPDNHTCQIQSYCAKHLKCSQKCDQNKFSVKCSCYEGWVLEPDGESCRSLDPFKPFIIFSNRHEIRRIDLHKGDYSVLVPGLRNTIALDFHLSQSALYWTDVVEDKIYRGKLLDNGALTSFEVVIQYGLATPEGLAVDWIAGNIYWVESNLDQIEVAKLDGTLRTTLLAGDIEHPRAIALDPRDGILFWTDWDASLPRIEAASMSGAGRRTVHRETGSGGWPNGLTVDYLEKRILWIDARSDAIYSARYDGSGHMEVLRGHEFLSHPFAVTLYGGEVYWTDWRTNTLAKANKWTGHNVTVVQRTNTQPFDLQVYHPSRQPMAPNPCEANGGQGPCSHLCLINYNRTVSCACPHLMKLHKDNTTCYEFKKFLLYARQMEIRGVDLDAPYYNYIISFTVPDIDNVTVLDYDAREQRVYWSDVRTQAIKRAFINGTGVETVVSADLPNAHGLAVDWVSRNLFWTSYDTNKKQINVARLDGSFKNAVVQGLEQPHGLVVHPLRGKLYWTDGDNISMANMDGSNRTLLFSGQKGPVGLAIDFPESKLYWISSGNHTINRCNLDGSGLEVIDAMRSQLGKATALAIMGDKLWWADQVSEKMGTCSKADGSGSVVLRNSTTLVMHMKVYDESIQLDHKGTNPCSVNNGDCSQLCLPTSETTRSCMCTAGYSLRSGQQACEGVGSFLLYSVHEGIRGIPLDPNDKSDALVPVSGTSLAVGIDFHAENDTIYWVDMGLSTISRAKRDQTWREDVVTNGIGRVEGIAVDWIAGNIYWTDQGFDVIEVARLNGSFRYVVISQGLDKPRAITVHPEKGYLFWTEWGQYPRIERSRLDGTERVVLVNVSISWPNGISVDYQDGKLYWCDARTDKIERIDLETGENREVVLSSNNMDMFSVSVFEDFIYWSDRTHANGSIKRGSKDNATDSVPLRTGIGVQLKDIKVFNRDRQKGTNVCAVANGGCQQLCLYRGRGQRACACAHGMLAEDGASCREYAGYLLYSERTILKSIHLSDERNLNAPVQPFEDPEHMKNVIALAFDYRAGTSPGTPNRIFFSDIHFGNIQQINDDGSRRITIVENVGSVEGLAYHRGWDTLYWTSYTTSTITRHTVDQTRPGAFERETVITMSGDDHPRAFVLDECQNLMFWTNWNEQHPSIMRAALSGANVLTLIEKDIRTPNGLAIDHRAEKLYFSDATLDKIERCEYDGSHRYVILKSEPVHPFGLAVYGEHIFWTDWVRRAVQRANKHVGSNMKLLRVDIPQQPMGIIAVANDTNSCELSPCRINNGGCQDLCLLTHQGHVNCSCRGGRILQDDLTCRAVNSSCRAQDEFECANGECINFSLTCDGVPHCKDKSDEKPSYCNSRRCKKTFRQCSNGRCVSNMLWCNGADDCGDGSDEIPCNKTACGVGEFRCRDGTCIGNSSRCNQFVDCEDASDEMNCSATDCSSYFRLGVKGVLFQPCERTSLCYAPSWVCDGANDCGDYSDERDCPGVKRPRCPLNYFACPSGRCIPMSWTCDKEDDCEHGEDETHCNKFCSEAQFECQNHRCISKQWLCDGSDDCGDGSDEAAHCEGKTCGPSSFSCPGTHVCVPERWLCDGDKDCADGADESIAAGCLYNSTCDDREFMCQNRQCIPKHFVCDHDRDCADGSDESPECEYPTCGPSEFRCANGRCLSSRQWECDGENDCHDQSDEAPKNPHCTSQEHKCNASSQFLCSSGRCVAEALLCNGQDDCGDSSDERGCHINECLSRKLSGCSQDCEDLKIGFKCRCRPGFRLKDDGRTCADVDECSTTFPCSQRCINTHGSYKCLCVEGYAPRGGDPHSCKAVTDEEPFLIFANRYYLRKLNLDGSNYTLLKQGLNNAVALDFDYREQMIYWTDVTTQGSMIRRMHLNGSNVQVLHRTGLSNPDGLAVDWVGGNLYWCDKGRDTIEVSKLNGAYRTVLVSSGLREPRALVVDVQNGYLYWTDWGDHSLIGRIGMDGSSRSVIVDTKITWPNGLTLDYVTERIYWADAREDYIEFASLDGSNRHVVLSQDIPHIFALTLFEDYVYWTDWETKSINRAHKTTGTNKTLLISTLHRPMDLHVFHALRQPDVPNHPCKVNNGGCSNLCLLSPGGGHKCACPTNFYLGSDGRTCVSNCTASQFVCKNDKCIPFWWKCDTEDDCGDHSDEPPDCPEFKCRPGQFQCSTGICTNPAFICDGDNDCQDNSDEANCDIHVCLPSQFKCTNTNRCIPGIFRCNGQDNCGDGEDERDCPEVTCAPNQFQCSITKRCIPRVWVCDRDNDCVDGSDEPANCTQMTCGVDEFRCKDSGRCIPARWKCDGEDDCGDGSDEPKEECDERTCEPYQFRCKNNRCVPGRWQCDYDNDCGDNSDEESCTPRPCSESEFSCANGRCIAGRWKCDGDHDCADGSDEKDCTPRCDMDQFQCKSGHCIPLRWRCDADADCMDGSDEEACGTGVRTCPLDEFQCNNTLCKPLAWKCDGEDDCGDNSDENPEECARFVCPPNRPFRCKNDRVCLWIGRQCDGTDNCGDGTDEEDCEPPTAHTTHCKDKKEFLCRNQRCLSSSLRCNMFDDCGDGSDEEDCSIDPKLTSCATNASICGDEARCVRTEKAAYCACRSGFHTVPGQPGCQDINECLRFGTCSQLCNNTKGGHLCSCARNFMKTHNTCKAEGSEYQVLYIADDNEIRSLFPGHPHSAYEQAFQGDESVRIDAMDVHVKAGRVYWTNWHTGTISYRSLPPAAPPTTSNRHRRQIDRGVTHLNISGLKMPRGIAIDWVAGNVYWTDSGRDVIEVAQMKGENRKTLISGMIDEPHAIVVDPLRGTMYWSDWGNHPKIETAAMDGTLRETLVQDNIQWPTGLAVDYHNERLYWADAKLSVIGSIRLNGTDPIVAADSKRGLSHPFSIDVFEDYIYGVTYINNRVFKIHKFGHSPLVNLTGGLSHASDVVLYHQHKQPEVTNPCDRKKCEWLCLLSPSGPVCTCPNGKRLDNGTCVPVPSPTPPPDAPRPGTCNLQCFNGGSCFLNARRQPKCRCQPRYTGDKCELDQCWEHCRNGGTCAASPSGMPTCRCPTGFTGPKCTQQVCAGYCANNSTCTVNQGNQPQCRCLPGFLGDRCQYRQCSGYCENFGTCQMAADGSRQCRCTAYFEGSRCEVNKCSRCLEGACVVNKQSGDVTCNCTDGRVAPSCLTCVGHCSNGGSCTMNSKMMPECQCPPHMTGPRCEEHVFSQQQPGHIASILIPLLLLLLLVLVAGVVFWYKRRVQGAKGFQHQRMTNGAMNVEIGNPTYKMYEGGEPDDVGGLLDADFALDPDKPTNFTNPVYATLYMGGHGSRHSLASTDEKRELLGRGPEDEIGDPLA

SEQ ID NO: 51915 - protein, 713 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRLVRRLRRWGLLPRTNTPARASEARSQVTPSAAPLEALDGGTGPAREGGAVGGQDGEQAPPLPIKAPLPSASTSPAPTTVPEAPGPLPSLPLEPSLLSGVVQALRGRLLPSLGPPGPTRSPPGPHTAVLALEDEDDVLLVPLAEPGVWVAEAEDEPLLT

SEQ ID NO: 51916 - protein, 556 aa, Homo sapiens
MLLATLLLLLLGGALAHPDRIIFPNHACEDPPAVLLEVQGTLQRPLVRDSRTSPANCTWLILGSKEQTVTIRFQKLHLACGSERLTLRSPLQPLISLCEAPPSPLQLPGGNVTITYSYAGARAPMGQGFLLSYSQDWLMCLQEEFQCLNHRCVSAVQRCDGVDACGDGSDEAGCSSDPFPGLTPRPVPSLPCNVTLEDFYGVFSSPGYTHLASVSHPQSCHWLLDPHDGRRLAVRFTALDLGFGDAVHVYDGPGPPESSRLLRSLTHFSNGKAVTVETLSGQAVVSYHTVAWSNGRGFNATYHVRGYCLPWDRPCGLGSGLGAGEGLGERCYSEAQRCDGSWDCADGTDEEDCPGCPPGHFPCGAAGTSGATACYLPADRCNYQTFCADGADERRCRHCQPGNFRCRDEKCVYETWVCDGQPDCADGSDEWDCSYVLPRKVITAAVIGSLVCGLLLVIALGCTCKLYAIRTQEYSIFAPLSRMEAEIVQQQAPPSYGQLIAQGAIPPVEDFPTENPNDNSVLGNLRSLLQILRQDMTPGGGPGARRRQRGRLMRRL

SEQ ID NO: 51917 - protein, 4655 aa, Homo sapiens
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGYLFFSDWESLSGEPKLERAFMDGSNRKDLVKTKLGWPAGVTLDMISKRVYWVDSRFDYIETVTYDGIQRKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIAVQNFLIFSSQVAIRGIPFTLSTQEDVMVPVSGNPSFFVGIDFDAQDSTIFFSDMSKHMIFKQKIDGTGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCNGNSCSDFNGGCTHECVQEPFGAKCLCPLGFLLANDSKTCEDIDECDILGSCSQHCYNMRGSFRCSCDTGYMLESDGRTCKVTASESLLLLVASQNKIIADSVTSQVHNIYSLVENGSYIVAVDFDSISGRIFWSDATQGKTWSAFQNGTDRRVVFDSSIILTETIAIDWVGRNLYWTDYALETIEVSKIDGSHRTVLISKNLTNPRGLALDPRMNEHLLFWSDWGHHPRIERASMDGSMRTVIVQDKIFWPCGLTIDYPNRLLYFMDSYLDYMDFCDYNGHHRRQVIASDLIIRHPYALTLFEDSVYWTDRATRRVMRANKWHGGNQSVVMYNIQWPLGIVAVHPSKQPNSVNPCAFSRCSHLCLLSSQGPHFYSCVCPSGWSLSPDLLNCLRDDQPFLITVRQHIIFGISLNPEVKSNDAMVPIAGIQNGLDVEFDDAEQYIYWVENPGEIHRVKTDGTNRTVFASISMVGPSMNLALDWISRNLYSTNPRTQSIEVLTLHGDIRYRKTLIANDGTALGVGFPIGITVDPARGKLYWSDQGTDSGVPAKIASANMDGTSVKTLFTGNLEHLECVTLDIEEQKLYWAVTGRGVIERGNVDGTDRMILVHQLSHPWGIAVHDSFLYYTDEQYEVIERVDKATGANKIVLRDNVPNLRGLQVYHRRNAAESSNGCSNNMNACQQICLPVPGGLFSCACATGFKLNPDNRSCSPYNSFIVVSMLSAIRGFSLELSDHSETMVPVAGQGRNALHVDVDVSSGFIYWCDFSSSVASDNAIRRIKPDGSSLMNIVTHGIGENGVRGIAVDWVAGNLYFTNAFVSETLIEVLRINTTYRRVLLKVTVDMPRHIVVDPKNRYLFWADYGQRPKIERSFLDCTNRTVLVSEGIVTPRGLAVDRSDGYVYWVDDSLDIIARIRINGENSEVIRYGSRYPTPYGITVFENSIIWVDRNLKKIFQASKEPENTEPPTVIRDNINWLRDVTIFDKQVQPRSPAEVNNNPCLENNGGCSHLCFALPGLHTPKCDCAFGTLQSDGKNCAISTENFLIFALSNSLRSLHLDPENHSPPFQTINVERTVMSLDYDSVSDRIYFTQNLASGVGQISYATLSSGIHTPTVIASGIGTADGIAFDWITRRIYYSDYLNQMINSMAEDGSNRTVIARVPKPRAIVLDPCQGYLYWADWDTHAKIERATLGGNFRVPIVNSSLVMPSGLTLDYEEDLLYWVDASLQRIERSTLTGVDREVIVNAAVHAFGLTLYGQYIYWTDLYTQRIYRANKYDGSGQIAMTTNLLSQPRGINTVVKNQKQQCNNPCEQFNGGCSHICAPGPNGAECQCPHEGNWYLANNRKHCIVDNGERCGASSFTCSNGRCISEEWKCDNDNDCGDGSDEMESVCALHTCSPTAFTCANGRCVQYSYRCDYYNDCGDGSDEAGCLFRDCNATTEFMCNNRRCIPREFICNGVDNCHDNNTSDEKNCPDRTCQSGYTKCHNSNICIPRVYLCDGDNDCGDNSDENPTYCTTHTCSSSEFQCASGRCIPQHWYCDQETDCFDASDEPASCGHSERTCLADEFKCDGGRCIPSEWICDGDNDCGDMSDEDKRHQCQNQNCSDSEFLCVNDRPPDRRCIPQSWVCDGDVDCTDGYDENQNCTRRTCSENEFTCGYGLCIPKIFRCDRHNDCGDYSDERGCLYQTCQQNQFTCQNGRCISKTFVCDEDNDCGDGSDELMHLCHTPEPTCPPHEFKCDNGRCIEMMKLCNHLDDCLDNSDEKGCGINECHDPSISGCDHNCTDTLTSFYCSCRPGYKLMSDKRTCVDIDECTEMPFVCSQKCENVIGSYICKCAPGYLREPDGKTCRQNSNIEPYLIFSNRYYLRNLTIDGYFYSLILEGLDNVVALDFDRVEKRLYWIDTQRQVIERMFLNKTNKETIINHRLPAAESLAVDWVSRKLYWLDARLDGLFVSDLNGGHRRMLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCEMRTCHPEYFQCTSGHCVHSELKCDGSADCLDASDEADCPTRFPDGAYCQATMFECKNHVCIPPYWKCDGDDDCGDGSDEELHLCLDVPCNSPNRFRCDNNRCIYSHEVCNGVDDCGDGTDETEEHCRKPTPKPCTEYEYKCGNGHCIPHDNVCDDADDCGDWSDELGCNKGKERTCAENICEQNCTQLNEGGFICSCTAGFETNVFDRTSCLDINECEQFGTCPQHCRNTKGSYECVCADGFTSMSDRPGKRCAAEGSSPLLLLPDNVRIRKYNLSSERFSEYLQDEEYIQAVDYDWDPKDIGLSVVYYTVRGEGSRFGAIKRAYIPNFESGRNNLVQEVDLKLKYVMQPDGIAVDWVGRHIYWSDVKNKRIEVAKLDGRYRKWLISTDLDQPAAIAVNPKLGLMFWTDWGKEPKIESAWMNGEDRNILVFEDLGWPTGLSIDYLNNDRIYWSDFKEDVIETIKYDGTDRRVIAKEAMNPYSLDIFEDQLYWISKEKGEVWKQNKFGQGKKEKTLVVNPWLTQVRIFHQLRYNKSVPNLCKQICSHLCLLRPGGYSCACPQGSSFIEGSTTECDAAIELPINLPPPCRCMHGGNCYFDETDLPKCKCPSGYTGKYCEMAFSKGISPGTTAVAVLLTILLIVVIGALAIAGFFHYRRTGSLLPALPKLPSLSSLVKPSENGNGVTFRSGADLNMDIGVSGFGPETAIDRSMAMSEDFVMEMGKQPIIFENPMYSARDSAVKVVQPIQVTVSENVDNKNYGSPINPSEIVPETNPTSPAADGTQVTKWNLFKRKSKQTTNFENPIYAQMENEQKESVAATPPPSPSLPAKPKPPSRRDPTPTYSATEDTFKDTANLVKEDSEV

SEQ ID NO: 51918 - protein, 1225 aa, Homo sapiens
MDRGPAAVACTLLLALVACLAPASGQECDSAHFRCGSGHCIPADWRCDGTKDCSDDADEIGCAVVTCQQGYFKCQSEGQCIPNSWVCDQDQDCDDGSDERQDCSQSTCSSHQITCSNGQCIPSEYRCDHVRDCPDGADENDCQYPTCEQLTCDNGACYNTSQKCDWKVDCRDSSDEINCTEICLHNEFSCGNGECIPRAYVCDHDNDCQDGSDEHACNYPTCGGYQFTCPSGRCIYQNWVCDGEDDCKDNGDEDGCESGPHDVHKCSPREWSCPESGRCISIYKVCDGILDCPGREDENNTSTGKYCSMTLCSALNCQYQCHETPYGGACFCPPGYIINHNDSRTCVEFDDCQIWGICDQKCESRPGRHLCHCEEGYILERGQYCKANDSFGEASIIFSNGRDLLIGDIHGRSFRILVESQNRGVAVGVAFHYHLQRVFWTDTVQNKVFSVDINGLNIQEVLNVSVETPENLAVDWVNNKIYLVETKVNRIDMVNLDGSYRVTLITENLGHPRGIAVDPTVGKTVVHGGSLIPHPFGVSLFEGQVFFTDWTKMAVLKANKFTETNPQVYYQASLRPYGVTVYHSLRQPYATNPCKDNNGGCEQVCVLSHRTDNDGLGFRCKCTFGFQLDTDERHCIGREILAANRVENVESLAFDWISKNLYWTDSHYKSISVMRLADKTRRTVVQYLNNPRSVVVHPFAGYLFFTDWFRPAKIMRAWSDGSHLLPVINTTLGWPNGLAIDWAASRLYWVDAYFDKIEHSTFDGLDRRRLGHIEQMTHPFGLAIFGEHLFFTDWRLGAIIRVRKADGGEMTVIRSGIAYILHLKSYDVNIQTGSNACNQPTHPNGDCSHFCFPVPNFQRVCGCPYGMRLASNHLTCEGDPTNEPPTEQCGLFSFPCKNGRCVPNYYLCDGVDDCHDNSDEQLCGTLNNTCSSSAFTCGHGECIPAHWRCDKRNDCVDGSDEHNCPTHAPASCLDTQYTCDNHQCISKNWVCDTDNDCGDGSDEKNCNSTETCQPSQFNCPNHRCIDLSFVCDGDKDCVDGSDEVGCVLNCTASQFKCASGDKCIGVTNRCDGVFDCSDNSDEAGCPTRPPGMCHSDEFQCQEDGICIPNFWECDGHPDCLYGSDEHNACVPKTCPSSYFHCDNGNCIHRAWLCDRDNDCGDMSDEKDCPTQPFRCPSWQWQCLGHNICVNLSVVCDGIFDCPNGTDESPLCSKFPDHSLLAINSF

SEQ ID NO: 51919 - protein, 646 aa, Homo sapiens
MLAQHCVDANNTFCFDNPRGLALHPQYGYLYWADWGHRAYIGRVGMDGTNKSVIISTKLEWPNGITIDYTNDLLYWADAHLGYIEYSDLEGHHRHTVYDGALPHPFAITIFEDTIYWTDWNTRTVEKGNKYDGSNRQTLVNTTHRPFDIHVYHPYRQPIVSNPCGTNNGGCSHLCLIKPGGKGFTCECPDDFRTLQLSGSTYCMPMCSSTQFLCANNEKCIPIWWKCDGQKDCSDGSDELALCPQRFCRLGQFQCSDGNCTSPQTLCNAHQNCPDGSDEDRLLCENHHCDSNEWQCANKRCIPESWQCDTFNDCEDNSDEDSSHCASRTCRPGQFRCANGRCIPQAWKCDVDNDCGDHSDEPIEECMSSAHLCDNFTEFSCKTNYRCIPKWAVCNGVDDCRDNSDEQGCEERTCHPVGDFRCKNHHCIPLRWQCDGQNDCGDNSDEENCAPRECTESEFRCVNQQCIPSRWICDHYNDCGDNSDERDCGMRLMKLIVPHAFLMVHTARLLCSNAKTMFVSRHIGNVMAMMTVAMVQMKNFTCAWMFPVIHQTVSGVTTIAAFIVMRCAMVWMTVEMELMRQRSTVENRPLNLVQNMNISVAMGIAFHMTMCVMMPMTVVTGPMNWVAIKEKKEHVLKIYASKIVPN

SEQ ID NO: 51920 - protein, 770 aa, Homo sapiens
MEKRAAAGLEGAPGARAQLAVVCLVNIFLTGRLSSAVPALAACSGKLEQHTERRGVIYSPAWPLNYPPGTNCSWYIQGDRGDMITISFRNFDVEESHQCSLDWLLLGPAAPPRQEAFRLCGSAIPPAFISARDHVWIFFHSDASSSGQAQGFRLSYIRGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQGCPACPPDQYPCEGGSGLCYTPADRCNNQKSCPDGADEKNCFSCQPGTFHCGTNLCIFETWRCDGQEDCQDGSDEHGCLAAVPRKVITAALIGSLVCGLLLVIALGCAFKLYSLRTQEYRAFETQMTRLEAEFVRREAPPSYGQLIAQGLIPPVEDFPVYSASQASVLQNLRTAMRRQMRRHASRRGPSRRRLGRLWNRLFHRPRAPRGQIPLLTAARPSQTVLGDGFLQPAPGAAPDPPAPLMDTGSTRAAGDRPPSAPGRAPEVGPSGPPLPSGLRDPECRPVDKDRKVCREPLVDGPAPADAPREPCSAQDPHPQVSTASSTLGPHSPEPLGVCRNPPPPCSPMLEASDDEALLVC

SEQ ID NO: 51921 - protein, 285 aa, Homo sapiens
MGNHLPAFGPRPPGRREALLSPDCPLLRLHPTGKLGQASCQADEFRCDNGKCLPGPWQCNTVDECGDGSDEGNCSAPASEPPGSLCPGGTFPCSGARSTRCLPVERRCDGLQDCGDGSDEAGCPDLACGRRLGSFYGSFASPDLFGAARGPSDLHCTWLVDTQDSRRVLLQLELRLGYDDYVQVYEGLGERGDRLLQTLSYRSNHRPVSLEAAQGRLTVAYHARARSAGHGFNATYQVKGYCLPWEQPCGSSSDSDGGSLGDQGCFSEPQRCDGWWHCASGRDEQ

SEQ ID NO: 51922 - protein, 1905 aa, Homo sapiens
MRRQWGALLLGALLCAHGLASSPECACGRSHFTCAVSALGECTCIPAQWQCDGDNDCGDHSDEDGCILPTCSPLDFHCDNGKCIRRSWVCDGDNDCEDDSDEQDCPPRECEEDEFPCQNGYCIRSLWHCDGDNDCGDNSDEQCDMRKCSDKEFRCSDGSCIAEHWYCDGDTDCKDGSDEENCPSAVPAPPCNLEEFQCAYGRCILDIYHCDGDDDCGDWSDESDCSSHQPCRSGEFMCDSGLCINAGWRCDGDADCDDQSDERNCTTSMCTAEQFRCHSGRCVRLSWRCDGEDDCADNSDEENCENTGSPQCALDQFLCWNGRCIGQRKLCNGVNDCGDNSDESPQQNCRPRTGEENCNVNNGGCAQKCQMVRGAVQCTCHTGYRLTEDGHTCQDVNECAEEGYCSQGCTNSEGAFQCWCETGYELRPDRRSCKALGPEPVLLFANRIDIRQVLPHRSEYTLLLNNLENAIALDFHHRRELVFWSDVTLDRILRANLNGSNVEEVVSTGLESPGGLAVDWVHDKLYWTDSGTSRIEVANLDGAHRKVLLWQNLEKPRAIALHPMEGTIYWTDWGNTPRIEASSMDGSGRRIIADTHLFWPNGLTIDYAGRRMYWVDAKHHVIERANLDGSHRKAVISQGLPHPFAITVFEDSLYWTDWHTKSINSANKFTGKNQEIIRNKLHFPMDIHTLHPQRQPAGKNRCGDNNGGCTHLCLPSGQNYTCACPTGFRKISSHACAQSLDKFLLFARRMDIRRISFDTEDLSDDVIPLADVRSAVALDWDSRDDHVYWTDVSTDTISRAKWDGTGQEVVVDTSLESPAGLAIDWVTNKLYWTDAGTDRIEVANTDGSMRTVLIWENLDRPRDIVVEPMGGYMYWTDWGASPKIERAGMDASGRQVIISSNLTWPNGLAIDYGSQRLYWADAGMKTIEFAGLDGSKRKVLIGSQLPHPFGLTLYGERIYWTDWQTKSIQSADRLTGLDRETLQENLENLMDIHVFHRRRPPVSTPCAMENGGCSHLCLRSPNPSGFSCTCPTGINLLSDGKTCSPGMNSFLIFARRIDIRMVSLDIPYFADVVVPINITMKNTIAIGVDPQEGKVYWSDSTLHRISRANLDGSQHEDIITTGLQTTDGLAVDAIGRKVYWTDTGTNRIEVGNLDGSMRKVLVWQNLDSPRAIVLYHEMGFMYWTDWGENAKLERSGMDGSDRAVLINNNLGWPNGLTVDKASSQLLWADAHTERIEAADLNGANRHTLVSPVQHPYGLTLLDSYIYWTDWQTRSIHRADKGTGSNVILVRSNLPGLMDMQAVDRAQPLGFNKCGSRNGGCSHLCLPRPSGFSCACPTGIQLKGDGKTCDPSPETYLLFSSRGSIRRISLDTSDHTDVHVPVPELNNVISLDYDSVDGKVYYTDVFLDVIRRADLNGSNMETVIGRGLKTTDGLAVDWVARNLYWTDTGRNTIEASRLDGSCRKVLINNSLDEPRAIAVFPRKGYLFWTDWGHIAKIERANLDGSERKVLINTDLGWPNGLTLDYDTRRIYWVDAHLDRIESADLNGKLRQVLVSHVSHPFALTQQDRWIYWTDWQTKSIQRVDKYSGRNKETVLANVEGLMDIIVVSPQRQTGTNACGVNNGGCTHLCFARASDFVCACPDEPDSRPCSLVPGLVPPAPRATGMSEKSPVLPNTPPTTLYSSTTRTRTSLEEVEGRCSERDARLGLCARSNDAVPAAPGEGLHISYAIGGLLSILLILVVIAALMLYRHKKSKFTDPGMGNLTYSNPSYRTSTQEVKIEAIPKPAMYNQLCYKKEGGPDHNYTKEKIKIVEGICLLSGDDAEWDDLKQLRSSRGGLLRDHVCMKTDTVSIQASSGSLDDTETEQLLQEEQSECSSVHTAATPERRGSLPDTGWKHERKLSSESQV

SEQ ID NO: 51923 - protein, 1615 aa, Homo sapiens
MEAAPPGPPWPLLLLLLLLLALCGCPAPAAASPLLLFANRRDVRLVDAGGVKLESTIVVSGLEDAAAVDFQFSKGAVYWTDVSEEAIKQTYLNQTGAAVQNVVISGLVSPDGLACDWVGKKLYWTDSETNRIEVANLNGTSRKVLFWQDLDQPRAIALDPAHGYMYWTDWGETPRIERAGMDGSTRKIIVDSDIYWPNGLTIDLEEQKLYWADAKLSFIHRANLDGSFRQKVVEGSLTHPFALTLSGDTLYWTDWQTRSIHACNKRTGGKRKEILSALYSPMDIQVLSQERQPFFHTRCEEDNGGCSHLCLLSPSEPFYTCACPTGVQLQDNGRTCKAGAEEVLLLARRTDLRRISLDTPDFTDIVLQVDDIRHAIAIDYDPLEGYVYWTDDEVRAIRRAYLDGSGAQTLVNTEINDPDGIAVDWVARNLYWTDTGTDRIEVTRLNGTSRKILVSEDLDEPRAIALHPVMGLMYWTDWGENPKIECANLDGQERRVLVNASLGWPNGLALDLQEGKLYWGDAKTDKIEVINVDGTKRRTLLEDKLPHIFGFTLLGDFIYWTDWQRRSIERVHKVKASRDVIIDQLPDLMGLKAVNVAKVVGTNPCADRNGGCSHLCFFTPHATRCGCPIGLELLSDMKTCIVPEAFLVFTSRAAIHRISLETNNNDVAIPLTGVKEASALDFDVSNNHIYWTDVSLKTISRAFMNGSSVEHVVEFGLDYPEGMAVDWMGKNLYWADTGTNRIEVARLDGQFRQVLVWRDLDNPRSLALDPTKGYIYWTEWGGKPRIVRAFMDGTNCMTLVDKVGRANDLTIDYADQRLYWTDLDTNMIESSNMLGQERVVIADDLPHPFGLTQYSDYIYWTDWNLHSIERADKTSGRNRTLIQGHLDFVMDILVFHSSRQDGLNDCMHNNGQCGQLCLAIPGGHRCGCASHYTLDPSSRNCSPPTTFLLFSQKSAISRMIPDDQHSPDLILPLHGLRNVKAIDYDPLDKFIYWVDGRQNIKRAKDDGTQPFVLTSLSQGQNPDRQPHDLSIDIYSRTLFWTCEATNTINVHRLSGEAMGVVLRGDRDKPRAIVVNAERGYLYFTNMQDRAAKIERAALDGTEREVLFTTGLIRPVALVVDNTLGKLFWVDADLKRIESCDLSGANRLTLEDANIVQPLGLTILGKHLYWIDRQQQMIERVEKTTGDKRTRIQGRVAHLTGIHAVEEVSLEEFSAHPCARDNGGCSHICIAKGDGTPRCSCPVHLVLLQNLLTCGEPPTCSPDQFACATGEIDCIPGAWRCDGFPECDDQSDEEGCPVCSAAQFPCARGQCVDLRLRCDGEADCQDRSDEADCDAICLPNQFRCASGQCVLIKQQCDSFPDCIDGSDELMCEITKPPSDDSPAHSSAIGPVIGIILSLFVMGGVYFVCQRVVCQRYAGANGPFPHEYVSGTPHVPLNFIAPGGSQHGPFTGIACGKSMMSSVSLMGGRGGVPLYDRNHVTGASSSSSSSTKATLYPPILNPPPSPATDPSLYNMDMFYSSNIPATARPYRPYIIRGMAPPTTPCSTDVCDSDYSASRWKASKYYLDLNSDSDPYPPPPTPHSQYLSAEDSCPPSPATERSYFHLFPPPPSPCTDSS

SEQ ID NO: 51924 - protein, 1613 aa, Homo sapiens
MGAVLRSLLACSFCVLLRAAPLLLYANRRDLRLVDATNGKENATIVVGGLEDAAAVDFVFSHGLIYWSDVSEEAIKRTEFNKTESVQNVVVSGLLSPDGLACDWLGEKLYWTDSETNRIEVSNLDGSLRKVLFWQELDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 51925 - protein, 1478 aa, Homo sapiens
  MOD_RES (1)..(1): Any amino acid
XLDQPRAIALDPSSGFMYWTDWGEVPKIERAGMDGSSRFIIINSEIYWPNGLTLDYEEQKLYWADAKLNFIHKSNLDGTNRQAVVKGSLPHPFALTLFEDILYWTDWSTHSILACNKYTGEGLREIHSDIFSPMDIHAFSQQRQPNATNPCGIDNGGCSHLCLMSPVKPFYQCACPTGVKLLENGKTCKDGATELLLLARRTDLRRISLDTPDFTDIVLQLEDIRHAIAIDYDPVEGYIYWTDDEVRAIRRSFIDGSGSQFVVTAQIAHPDGIAVDWVARNLYWTDTGTDRIEVTRLNGTMRKILISEDLEEPRAIVLDPMVGYMYWTDWGEIPKIERAALDGSDRVVLVNTSLGWPNGLALDYDEGKIYWGDAKTDKIEVMNTDGTGRRVLVEDKIPHIFGFTLLGDYVYWTDWQRRSIERVHKRSAEREVIIDQLPDLMGLKATNVHRVIGSNPCAEENGGCSHLCLYRPQGLRCACPIGFELISDMKTCIVPEAFLLFSRRADIRRISLETNNNNVAIPLTGVKEASALDFDVTDNRIYWTDISLKTISRAFMNGSALEHVVEFGLDYPEGMAVDWLGKNLYWADTGTNRIEVSKLDGQHRQVLVWKDLDSPRALALDPAEGFMYWTEWGGKPKIDRAAMDGSERTTLVPNVGRANGLTIDYAKRRLYWTDLDTNLIESSNMLGLNREVIADDLPHPFGLTQYQDYIYWTDWSRRSIERANKTSGQNRTIIQGHLDYVMDILVFHSSRQSGWNECASSNGHCSHLCLAVPVGGFVCGCPAHYSLNADNRTCSAPTTFLLFSQKSAINRMVIDEQQSPDIILPIHSLRNVRAIDYDPLDKQLYWIDSRQNMIRKAQEDGSQGFTVVVSSVPSQNLEIQPYDLSIDIYSRYIYWTCEATNVINVTRLDGRSVGVVLKGEQDRPRAVVVNPEKGYMYFTNLQERSPKIERAALDGTEREVLFFSGLSKPIALALDSRLGKLFWADSDLRRIESSDLSGANRIVLEDSNILQPVGLTVFENWLYWIDKQQQMIEKIDMTGREGRTKVQARIAQLSDIHAVKELNLQEYRQHPCAQDNGGCSHICLVKGDGTTRCSCPMHLVLLQDELSCGEPPTCSPQQFTCFTGEIDCIPVAWRCDGFTECEDHSDELNCPVCSESQFQCASGQCIDGALRCNGDANCQDKSDEKNCEVLCLIDQFRCANGQCIGKHKKCDHNVDCSDKSDELDCYPTEEPAPQATNTVGSVIGVIVTIFVSGTVYFICQRMLCPRMKGDGETMTNDYVVHGPASVPLGYVPHPSSLSGSLPGMSRGKSMISSLSIMGGSSGPPYDRAHVTGASSSSSSSTKGTYFPAILNPPPSPATERSHYTMEFGYSSNSPSTHRSYSYRPYSYRHFAPPTTPCSTDVCDSDYAPSRRMTSVATAKGYTSDLNYDSEPVPPPPTPRSQYLSAEENYESCPPSPYTERSYSHHLYPPPPSPCTDSS

SEQ ID NO: 51926 - protein, 793 aa, Homo sapiens
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATWLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 51927 - protein, 963 aa, Homo sapiens
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPAAISSFDRPLWAEPCLGETREPEDPAPALKELFVLPGEPRSQLHQLPKNPLSELPVVKSKRVALSLEDDGLP

SEQ ID NO: 51928 - protein, 700 aa, Homo sapiens
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATSLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRDANEDSKMGSTVTAAVIGIIVPIVVIALLCMSGYLIWRNWKRKNTKSMNFDNPVYRKTTEEEDEDELHIGRTAQIGHVYPARVALSLEDDGLP

SEQ ID NO: 51929 - protein, 904 aa, Homo sapiens
MGLPEPGPLRLLALLLLLLLLLLLQLQHLAAAAADPLLGGQGPAKDCEKDQFQCRNERCIPSVWRCDEDDDCLDHSDEDDCPKKTCADSDFTCDNGHCIHERWKCDGEEECPDGSDESEATCTKQVCPAEKLSCGPTSHKCVPASWRCDGEKDCEGGADEAGCATLCAPHEFQCGNRSCLAAVFVCDGDDDCGDGSDERGCADPACGPREFRCGGDGGGACIPERWVCDRQFDCEDRSDEAAELCGRPGPGATSAPAACATASQFACRSGECVHLGWRCDGDRDCKDKSDEADCPLGTCRGDEFQCGDGTCVLAIKHCNQEQDCPDGSDEAGCLQGLNECLHNNGGCSHICTDLKIGFECTCPAGFQLLDQKTCGDIDECKDPDACSQICVNYKGYFKCECYPGYEMDLLTKNCKAAAGKSPSLIFTNRHEVRRIDLVKRNYSRLIPMLKNVVALDVEVATNRIYWCDLSYRKIYSAYMDKASDPKEQEVLIDEQLHSPEGLAVDWVHKHIYWTDSGNKTISVATVDGGRRRTLFSRNLSEPRAIAVDPLRGFMYWSDWGDQAKIEKSGLNGVDRQTLVSDNIEWPNGITLDLLSQRLYWVDSKLHQLSSIDFSGGNRKTLISSTDFLSHPFGIAVFEDKVFWTDLENEAIFSANRLNGLEISILAENLNNPHDIVIFHELKQPRAPDACELSVQPNGGCEYLCLPAPQISSHSPKYTCACPDTMWLGPDMKRCYRAPQSTSTTTLASTMTRTVPATTRAPGTTVHRSTYQNHSTETPSLTAAVPSSVSVPRAPSISPSTLSPATSNHSQHYANEDSKMGSTVTAAVIGIIVPIVVIALLCMSGYLIWRNWKRKNTKSMNFDNPVYRKTTEEEDEDELHIGRTAQIGHVYPARVALSLEDDGLP

SEQ ID NO: 51930 - protein, 357 aa, Homo sapiens
MAPRRVRSFLRGLPALLLLLLFLGPWPAASHGGKYSREKNQPKPSPKRESGEEFRMEKLNQLWEKAQRLHLPPVRLAELHADLKIQERDELAWKKLKLDGLDEDGEKEARLIRNLNVILAKYGLDGKKDARQVTSNSLSGTQEDGLDDPRLEKLWHKAKTSGKFSGEELDKLWREFLHHKEKVHEYNVLLETLSRTEEIHENVISPSDLSDIKGSVLHSRHTELKEKLRSINQGLDRLRRVSHQGYSTEAEFEEPRVIDLWDLAQSANLTDKELEAFREELKHFEAKIEKHNHYQKQLEIAHEKLRHAESVGDGERVSRSREKHALLEGRTKELGYTVKKHLQDLSGRISRARHNEL

SEQ ID NO: 51931 - protein, 133 aa, Homo sapiens
MNYMPGTASLIEDIDKKHLVLLRDGRTLIGFLRSIDQFANLVLHQTVERIHVGKKYGDIPRGIFVVRGENVVLLGEIDLEKESDTPLQQVSIEEILEEQRVEQQTKLEAEKLKVQALKDRGLSIPRADTLDEY

SEQ ID NO: 51932 - protein, 195 aa, Homo sapiens
MAAPPGEYFSVGSQVSCRTCQEQRLQGEVVAFDYQSKMLALKCPSSSGKPNHADILLINLQYVSEVEIINDRTETPPPLASLNVSKLASKARTEKEEKLSQAYAISAGVSLEGQQLFQTIHKTIKDCKWQEKNIVVMEEVVITPPYQVENCKGKEGSALSHVRKIVEKHFRDVESQKILQRSQAQQPQKEAALSS

SEQ ID NO: 51933 - protein, 195 aa, Homo sapiens; identical to SEQ ID NO: 51932

SEQ ID NO: 51934 - protein, 95 aa, Homo sapiens
MLFYSFFKSLVGKDVVVELKNDLSICGTLHSVDQYLNIKLTDISVTDPEKYPHMLSVKNCFIRGSVVRYVQLPADEVDTQLLQDAARKEALQQKQ

SEQ ID NO: 51935 - protein, 95 aa, Homo sapiens; identical to SEQ ID NO: 51934

SEQ ID NO: 51936 - protein, 95 aa, Homo sapiens; identical to SEQ ID NO: 51934

SEQ ID NO: 51937 - protein, 95 aa, Homo sapiens; identical to SEQ ID NO: 51934

SEQ ID NO: 51938 - protein, 95 aa, Homo sapiens; identical to SEQ ID NO: 51934

SEQ ID NO: 51939 - protein, 95 aa, Homo sapiens; identical to SEQ ID NO: 51934

SEQ ID NO: 51940 - protein, 102 aa, Homo sapiens
MADDVDQQQTTNTVEEPLDLIRLSLDERIYVKMRNDRELRGRLHAYDQHLNMILGDVEETVTTIEIDEETYEEIYKSTKRNIPMLFVRGDGVVLVAPPLRVG

SEQ ID NO: 51941 - protein, 139 aa, Homo sapiens
MLPLSLLKTAQNHPMLVELKNGETYNGHLVSCDNWMNINLREVICTSRDGDKFWRMPECYIRGSTIKYLRIPDEIIDMVKEEVVAKGRGRGGLQQQKQQKGRGMGGAGRGVFGGRGRGGIPGTGRGQPEKKPGRQAGKQ

SEQ ID NO: 51942 - protein, 139 aa, Homo sapiens; identical to SEQ ID NO: 51941

SEQ ID NO: 51943 - protein, 91 aa, Homo sapiens
MAANATTNPSQLLPLELVDKCIGSRIHIVMKSDKEIVGTLLGFDDFVNMVLEDVTEFEITPEGRRITKLDQILLNGNNITMLVPGGEGPEV

SEQ ID NO: 51944 - protein, 80 aa, Homo sapiens
MSLRKQTPSDFLKQIIGRPVVVKLNSGVDYRGVLACLDGYMNIALEQTEEYVNGQLKNKYGDAFIRGNNVLYISTQKRRM

SEQ ID NO: 51945 - protein, 80 aa, Homo sapiens; identical to SEQ ID NO: 51944

SEQ ID NO: 51946 - protein, 80 aa, Homo sapiens; identical to SEQ ID NO: 51944

SEQ ID NO: 51947 - protein, 80 aa, Homo sapiens; identical to SEQ ID NO: 51944

SEQ ID NO: 51948 - protein, 103 aa, Homo sapiens
MADKEKKKKESILDLSKYIDKTIRVKFQGGREASGILKGFDPLLNLVLDGTIEYMRDPDDQYKLTEDTRQLGLVVCRGTSVVLICPQDGMEAIPNPFIQQQDA

SEQ ID NO: 51949 - protein, 371 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYKFSRERASREESWESGRSERGPPDWRLESSNGKMASRRSEEKEAGEI

SEQ ID NO: 51950 - protein, 325 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYK

SEQ ID NO: 51951 - protein, 272 aa, Homo sapiens
MDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRRRSRSRDRRRRRSRSTSRERRKLSRSRSRDRHRRHRSRSRSHSRGHRRASRDRSAKYK

SEQ ID NO: 51952 - protein, 325 aa, Homo sapiens; identical to SEQ ID NO: 51950

SEQ ID NO: 51953 - protein, 32 aa, Homo sapiens
MDLGECTKIHDLALRADYEIASKERDLFFELD

SEQ ID NO: 51954 - protein, 182 aa, Homo sapiens
MDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREERLSRRSGSRTRDRR

SEQ ID NO: 51955 - protein, 60 aa, Homo sapiens
  MOD_RES (1)..(1): Any amino acid
XRRRSRSRDRRRRRSRSTSRERRKLSRSRSRDRHRRHRSRSRSHSRGHRRASRDRSAKYK

SEQ ID NO: 51956 - protein, 84 aa, Homo sapiens
MDHLESFIAECDRRTELAKKRLAETQEEISAEVSAKAEKVHELNEEIGKLLAKAEQLGAEGNVDESQKILMEVEKVRAKKKEAE

SEQ ID NO: 51957 - protein, 391 aa, Homo sapiens
MPAYLNLQGSVRKAPHSPSRDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 51958 - protein, 392 aa, Homo sapiens
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 51959 - protein, 389 aa, Homo sapiens
MVIHSQLKKIQGASERMGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 51960 - protein, 458 aa, Homo sapiens
MAALGSPSHTFRGLLRELRYLSAATGRPYRDTAAYRYLVKAFRAHRVTSEKLCRAQHELHFQAATYLCLLRSIRKHVALHQEFHGKGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREEREKLRRSRSHSKNPKRSRSREHRRHRSRSMSRERKRRTRSKSREKRHRHRSRSSSRSRSRSHQRSRHSSRDRSRERSKRRSSKERFRDQDLASCDRDRSSRDRSPRDRDRKDKKRSYESANGRSEDRRSSEEREAGEI

SEQ ID NO: 51961 - protein, 392 aa, Homo sapiens; identical to SEQ ID NO: 51958

SEQ ID NO: 51962 - protein, 83 aa, Homo sapiens
MSAQAQMRAMLDQLMGTSRDGSMYLCLPTSICKGVSERPRIRQAEIQLVNESNSVMTEYARVTFSTVVLMMSFLELEWILENV

SEQ ID NO: 51963 - protein, 432 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGDTQSN

SEQ ID NO: 51964 - protein, 79 aa, Homo sapiens
MISAAQLLDELMGRDRNLAPDEKRSNVRWDHESVCKYYLCGFCPAELFTNTRSDLDVFGRGDNIRDVSKFLEDDKWMEE

SEQ ID NO: 51965 - protein, 432 aa, Homo sapiens; identical to SEQ ID NO: 51963

SEQ ID NO: 51966 - protein, 236 aa, Homo sapiens
MISAAQLLDELMGRDRNLAPDEKRSNVRWDHESVCKYYLCGFCPAELFTNTRSDLGPCEKIHDENLRKQYEKSSRFMKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEEKKKKKKK

SEQ ID NO: 51967 - protein, 356 aa, Homo sapiens
MKVGYERDFLRYLQSLLAEVERRIRRGHARLALSQNQQSSGAAGPTGKNEEKIQVLTDKIDVLLQQIEELGSEGKVEEAQGMMKLVEQLKEERELLRSTTSTIESFAAQEKQMEVCEVCGAFLIVGDAQSRVDDHLMGKQHMGYAKIKATVEELKEKLRKRTEEPDRDERLKKEKQEREEREKEREREREERERKRRREEEEREKERARDRERRKRSRSRSRHSSRTSDRRCSRSRDHKRSRSRERRRSRSRDRRRSRSHDRSERKHRSRSRDRRRSKSRDRKSYKHRSKSRDREQDRKSKEKEKRGSDDKKSSVKSGSREKQSEDTNTESKESDTKNEVNGTSEDIKSEGLFVTV

SEQ ID NO: 51968 - protein, 338 aa, Homo sapiens
MSLSAFTLFLALIGGTSGQYYDYDFPLSIYGQSSPNCAPECNCPESYPSAMYCDELKLKSVPMVPPGIKYLYLRNNQIDHIDEKAFENVTDLQWLILDHNLLENSKIKGRVFSKLKQLKKLHINHNNLTESVGPLPKSLEDLQLTHNKITKLGSFEGLVNLTFIHLQHNRLKEDAVSAAFKGLKSLEYLDLSFNQIARLPSGLPVSLLTLYLDNNKISNIPDEYFKRFNALQYLRLSHNELADSGIPGNSFNVSSLVELDLSYNKLKNIPTVNENLENYYLEVNQLEKFDIKSFCKILGPLSYSKIKHLRLDGNRISETSLPPDMYECLRVANEVTLN

SEQ ID NO: 51969 - protein, 699 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 51970 - protein, 637 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLQNFSHSISENFSKQCESTVRKVNNKTLYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 51971 - protein, 325 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLSKPRINGYQ

SEQ ID NO: 51972 - protein, 329 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKEQNFSHSISENFSKQCESTVRKVNNKTLLLHGALSAAHSLS

SEQ ID NO: 51973 - protein, 672 aa, Homo sapiens
MKQRFSALQLLKLLLLLQPPLPRALREALCPEPCNCVPDGALRCPGPTAGLTRLSLAYLPVKVIPSQAFRGLNEVIKIEISQIDSLERIEANAFDNLLNLSEILIQNTKNLRYIEPGAFINLPRLKYLSICNTGIRKFPDVTKVFSSESNFILEICDNLHITTIPGNAFQGMNNESVTLKLYGNGFEEVQSHAFNGTTLTSLELKENVHLEKMHNGAFRGATGPKTLDISSTKLQALPSYGLESIQRLIATSSYSLKKLPSRETFVNLLEATLTYPSHCCAFRNLPTKDYSSMLAESELSGWDYEYGFCLPKTPRCAPEPDAFNPCEDIMGYDFLRVLIWLINILAIMGNMTVLFVLLTSRYKLTVPRFLMCNLSFADFCMGLYLLLIASVDSQTKGQYYNHAIDWQTGSGCSTAGFFTVFASELSVYTLTVITLERWHTITYAIHLDQKLRLRHAILIMLGGWLFSSLIAMLPLVGVSNYMKVSICFPMDVETTLSQVYILTILILNVVAFFIICACYIKIYFAVRNPELMATNKDTKIAKKMAILIFTDFTCMAPISFFAISAAFKVPLITVTNSKVLLVLFYPINSCANPFLYAIFTKTFQRDFFLLLSKFGCCKRRAELYRRKDFSAYTSNCKNGFTGSNKPSQSTLKLSTLHCQGTALLDKTRYTEC

SEQ ID NO: 51974 - protein, 131 aa, Homo sapiens
MTPLLTLILVVLMGLPLAQALDCHVCAYNGDNCFNPMRCPAMVAYCMTTRTSAAEAIWCHQCTGFGGCSHGSRCLRDSTHCVTTATRVLSNTEDLPLVTKMCHIGCPDIPSLGLGPYVSIACCQTSLCNHD

SEQ ID NO: 51975 - protein, 116 aa, Homo sapiens
MTPLLTLILVVLMGLPLAQALDCHVCAYNGDNCFNPMRCPAMVAYCMTTRTYYTPTRMKVSKSCVPRCFETVYDGYSKHASTTSCCQYDLCNGTGLATPATLALAPILLATLWGLL

SEQ ID NO: 51976 - protein, 116 aa, Homo sapiens; identical to SEQ ID NO: 51975

SEQ ID NO: 51977 - protein, 116 aa, Homo sapiens; identical to SEQ ID NO: 51975

SEQ ID NO: 51978 - protein, 82 aa, Homo sapiens
MTPLLTLILVVLMGLPLAQALDCHVCAYNGDNCFNPMRCPAMVAYCMTTRTYYTPTRMKVSKSCVPRCFETVYDGYSKHAST

SEQ ID NO: 51979 - protein, 84 aa, Homo sapiens
MTPLLTLILVVLMGLPLAQALDCHVCAYNGDNCFNPMRCPAMVAYCMTTRTYYTPTRMKVSKSCVPRCFETVYDGYSKHASTTS

SEQ ID NO: 51980 - protein, 346 aa, Homo sapiens [sequence omitted]

SEQ ID NO: 51981 - protein, 294 aa, Homo sapiens
MDPARKAGAQAMIWTAGWLLLLLLRGGAQALECYSCVQKADDGCSPNKMKTVKCAPGVDVCTEAVGAVETIHGQFSLAVRGCGSGLPGKNDRGLDLHGLLAFIQLQQCAQDRCNAKLNLTSRALDPAAAANVTVSLPVRGCVQDEFCTRDGVTGPGFTLSGSCCQGSRCNSDLRNKTYFSPRIPPLVRLPPPEPTTVASTTSVTTSTSAPVRPTSTTKPMPAPTSQTPRQGVEHEASRDEEPRLTGGAAGHQDRSNSGQYPAKGGPQQPHNKGCVAPTAGLAALLLAVAAGVLL

SEQ ID NO: 51982 - protein, 171 aa, Homo sapiens
MEPGPALAWLLLLSLLADCLKAAQSRDFTVKDIIYLHPSTTPYPGGFKCFTCEKAADNYECNRWAPDIYCPRETRYCYTQHTMEVTGNSISVTKRCVPLEECLSTGCRDSEHEGHKVCTSCCEGNICNLPLPRNETDATFATTSPINQTNGHPRCMSVIVSCLWLWLGLML

SEQ ID NO: 51983 - protein, 171 aa, Homo sapiens; identical to SEQ ID NO: 51982

SEQ ID NO: 51984 - protein, 53 aa, Homo sapiens
MEPGPALAWLLLLSLLADCLKAAQSRDFTVKDIIYLHPSTTPYPGGFKCFTCE

SEQ ID NO: 51985 - protein, 322 aa, Homo sapiens
MARCFSLVLLLTSIWTTRLLVQGSLRAEELSIQVSCRIMGITLVSKKANQQLNFTEAKEACRLLGLSLAGKDQVETALKASFETCSYGWVGDGFVVISRISPNPKCGKNGVGVLIWKVPVSRQFAAYCYNSSDTWTNSCIPEIITTKDPIFNTQTATQTTEFIVSDSTYSVASPYSTIPAPTTTPPAPASTSIPRRKKLICVTEVFMETSTMSTETEPFVENKAAFKNEAAGFGGVPTALLVLALLFFGAAAGLGFCYVKRYVKAFPFTNKNQQKEMIETKVVKEEKANDSNPNEESKKTDKNPEESKSPSKTTVRCLEAEV

SEQ ID NO: 51986 - protein, 128 aa, Homo sapiens
MRTALLLLAALAVATGPALTLRCHVCTSSSNCKHSVVCPASSRFCKTTNTVEPLRGNLVKKDCAESCTPSYTLQGQVSSGTSSTQCCQEDLCNEKLHNAAPTRTALAHSALSLGLALSLLAVILAPSL

SEQ ID NO: 51987 - protein, 131 aa, Homo sapiens
MKIFLPVLLAALLGVERASSLMCFSCLNQKSNLYCLKPTICSDQDNYCVTVSASAGIGNLVTFGHSLSKTCSPACPIPEGVNVGVASMGISCCQSFLCNFSAADGGLRASVTLLGAGLLLSLLPALLRFGP

SEQ ID NO: 51988 - protein, 131 aa, Homo sapiens; identical to SEQ ID NO: 51987

SEQ ID NO: 51989 - protein, 88 aa, Homo sapiens
MKIFLPVLLAALLGVERASSLMCFSCLNQKSNLYCLKPTICSDQDNYCVTVSASAGIGNLVTFGHSLSKTCSPACPIPEGVNVGVASM

SEQ ID NO: 51990 - protein, 131 aa, Homo sapiens; identical to SEQ ID NO: 51987

SEQ ID NO: 51991 - protein, 131 aa, Homo sapiens; identical to SEQ ID NO: 51987

SEQ ID NO: 51992 - protein, 131 aa, Homo sapiens; identical to SEQ ID NO: 51987

SEQ ID NO: 51993 - protein, 131 aa, Homo sapiens; identical to SEQ ID NO: 51987

SEQ ID NO: 51994 - protein, 131 aa, Homo sapiens; identical to SEQ ID NO: 51987

SEQ ID NO: 51995 - protein, 133 aa, Homo sapiens
MKPQFVGILLSSLLGAALGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 51996 - protein, 174 aa, Homo sapiens
MKPQFVGILLSSLLGAALGNRMRCYNCGGSPSSSCKEAVTTCGEGRPQPGLEQIKLPGNRRCFLRGLKIPLGSLKSHLLCPRRQVLKPGVQHPSFILSLSPSDLDSPTSSLRRSPSLQSSGDRVGGRRDLSSPQGLLPGRPVQQRRGKPCGPCRHFGCSSYRPDLSLARTVERI

SEQ ID NO: 51997 - protein, 133 aa, Homo sapiens; identical to SEQ ID NO: 51995

SEQ ID NO: 51998 - protein, 382 aa, Homo sapiens
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCTVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 51999 - protein, 133 aa, Homo sapiens; identical to SEQ ID NO: 51995

SEQ ID NO: 52000 - protein, 133 aa, Homo sapiens; identical to SEQ ID NO: 51995

SEQ ID NO: 52001 - protein, 382 aa, Homo sapiens
MAVLFLLLFLCGTPQAADNMQAIYVALGEAVELPCPSPPTLHGDEHLSWFCSPAAGSFTTLVAQVQVGRPAPDPGKPGRESRLRLLGNYSLWLEGSKEEDAGRYWCAVLGQHHNYQNWRVYDVLVLKGSQLSARAADGSPCNVLLCSVVPSRRMDSVTWQEGKGPVRGRVQSFWGSEAALLLVCPGEGLSEPRSRRPRIIRCLMTHNKGVSFSLAASIDASPALCAPSTGWDMPWILMLLLTMGQGVVILALSIVLWRQRVRGAPGRGNRMRCYNCGGSPSSSCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 52002 - protein, 133 aa, Homo sapiens
MKPQFVGILLSSLLGAALGNRMRCYNCGGSPSSTCKEAVTTCGEGRPQPGLEQIKLPGNPPVTLIHQHPACVAAHHCNQVETESVGDVTYPAHRDCYLGDLCNSAVASHVAPAGILAAAATALTCLLPGLWSG

SEQ ID NO: 52003 - protein, 133 aa, Homo sapiens; identical to SEQ ID NO: 51995

SEQ ID NO: 52004 - protein, 133 aa, Homo sapiens; identical to SEQ ID NO: 51995

SEQ ID NO: 52005 - protein, 174 aa, Homo sapiens; identical to SEQ ID NO: 51996

SEQ ID NO: 52006 - protein, 161 aa, Homo sapiens
MLAPQRTRAPSPRAAPRPTRSMLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 52007 - protein, 161 aa, Homo sapiens; identical to SEQ ID NO: 52006

SEQ ID NO: 52008 - protein, 140 aa, Homo sapiens
MLPAAMKGLGLALLAVLLCSAPAHGLWCQDCTLTTNSSHCTPKQCQPSDTVCASVRITDPSSSRKDHSVNKMCASSCDFVKRHFFSDYLMGFINSGILKVDVDCCEKDLCNGAAGAGHSPWALAGGLLLSLGPALLWAGP

SEQ ID NO: 52009 - protein, 656 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVVPPPQQNDLEIPESPTYENFT

SEQ ID NO: 52010 - protein, 521 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRPERNTKLWIGLFLMVCLLCVGIFSWCIWKRKGRCSVPAFCSSQAEAPADTPGYEKLDTPLRKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 52011 - protein, 270 aa, Homo sapiens
MTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQVVPPPQQNDLEIPESPTYENFT

SEQ ID NO: 52012 - protein, 270 aa, Homo sapiens; identical to SEQ ID NO: 52011

SEQ ID NO: 52013 - protein, 655 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVPPPQQNDLEIPESPTYENFT

SEQ ID NO: 52014 - protein, 371 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRESLGRAPITRFLL

SEQ ID NO: 52015 - protein, 602 aa, Homo sapiens
MGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRRLRKPKITWSLRHSEDGICRISLTCSVEDGGNTVMYTWTPLQKEAVVSQGESHLNVSWRSSENHPNLTCTASNPVSRSSHQFLSENICSGPERNTKLWIGLFLMVCLLCVGIFSWCIWKRKGRCSVPAFCSSQAEAPADTPGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVVPPPQQNDLEIPESPTYENFT

SEQ ID NO: 52016 - protein, 193 aa, Homo sapiens
MVAPKSHTDDWAPGPFSSKPQRSQLQIFSSVLQTSLLFLLMGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYAPFIEKLSVHVIEGDHRTLLEGSGLESIISTLAEPRVSVREG

SEQ ID NO: 52017 - protein, 526 aa, Homo sapiens
MGLRASGKDSAPTVVSGILGGSVTLPLNISVDTEIENVIWIGPKNALAFARPKENVTIMVKSYLGRLDITKWSYSLCISNLTLNDAGSYKAQINQRNFEVTTEEEFTLFVYEQLQEPQVTMKSVKVSENFSCNITLMCSVKGAEKSVLYSWTPREPHASESNGGSILTVSRTPCDPDLPYICTAQNPVSQRSSLPVHVGQFCTDPGASRGGTTGETVVGVLGEPVTLPLALPACRDTEKVVWLFNTSIISKEREEAATADPLIKSRDPYKNRVWVSSQDCSLKISQLKIEDAGPYHAYVCSEASSVTSMTHVTLLIYRPERNTKLWIGLFLMVCLLCVGIFSWCIWKRKGRCSVPAFCSSQAEAPADTPEPTAGHTLYSVLSQGYEKLDTPLRPARQQPTPTSDSSSDSNLTTEEDEDRPEVHKPISGRYEVFDQVTQEGAGHDPAPEGQADYDPVTPYVTEVESVVGENTMYAQVFNLQGKTPVSQKEESSATIYCSIRKPQVVVPPPQQNDLEIPESPTYENFT

SEQ ID NO: 52018 - protein, 627 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNEALIALLREGESLEDLMKLSPEELLLRWANYHLENAGCNKIGNFSTDIKDSKAYYHLLEQVAPKGDEEGVPAVVIDMSGLREKDDIQRAECMLQQAERLGCRQFVTATDVVRGNPKLNLAFIANLFNRYPALHKPENQDIDWGALEGETREERTFRNWMNSLGVNPRVNHLYSDLSDALVIFQLYEKIKVPVDWNRVNKPPYPKLGGNMKKLENCNYAVELGKNQAKFSLVGIGGQDLNEGNRTLTLALIWQLMRRYTLNILEEIGGGQKVNDDIIVNWVNETLREAKKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 52019 - protein, 627 aa, Homo sapiens; identical to SEQ ID NO: 52018

SEQ ID NO: 52020 - protein, 246 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNE

SEQ ID NO: 52021 - protein, 196 aa, Homo sapiens
MCAEDGDSKFSMSISMNSPFLEILHLENCNYAVELGKNQAKFSLVGIGGQDLNEGNRTLTLALIWQLMRRYTLNILEEIGGGQKVNDDIIVNWVNETLREAKKSSSISSFKDPKISTSLPVLDLIDAIQPGSINYDLLKTENLNDDEKLNNAKYAISMARKIGARVYALPEDLVEVNPKMVMTVFACLMGKGMKRV

SEQ ID NO: 52022 - protein, 66 aa, Homo sapiens
MARGSVSDEEMMELREAFAKVDTDGNGYISFNELNDLFKAACLPLPGYRVREITENLMATGDLDQD

SEQ ID NO: 52023 - protein, 533 aa, Homo sapiens
MALRNVPFRSEVLGWDPDSLADYFKKLNYKDCEKAVKKYHIDGARFLNLTENDIQKFPKLRVPILSKLSQEINKNEERRSIFTRKPQVPRFPEETESHEEDNGGWSSFEEDDYESPNDDQDGEDDGDYESPNEEEEAPVEDDADYEPPPSNDEEALQNSILPAKPFPNSNSMYIDRPPSGKTPQQPPVPPQRPMAALPPPPAGRNHSPLPPPQTNHEEPSRSRNHKTAKLPAPSIDRSTKPPLDRSLAPFDREPFTLGKKPPFSDKPSIPAGRSLGEHLPKIQKPPLPPTTERHERSSPLPGKKPPVPKHGWGPDRRENDEDDVHQRPLPQPALLPMSSNTFPSRSTKPSPMNPLPSSHMPGAFSESNSSFPQSASLPPYFSQGPSNRPPIRAEGRNFPLPLPNKPRPPSPAEEENSLNEEWYVSYITRPEAEAALRKINQDGTFLVRDSSKKTTTNPYVLMVLYKDKVYNIQIRYQKESQVYLLGTGLRGKEDFLSVSDIIDYFRKMPLLLIDGKNRGSRYQCTLTHAAGYP

SEQ ID NO: 52024 - protein, 525 aa, Homo sapiens
MWEAQFLGLLFLQPLWVAPVKPLQPGAEVPVVWAQEGAPAQLPCSPTIPLQDLSLLRRAGVTWQHQPDSGPPAAAPGHPLAPGPHPAAPSSWGPRPRRYTVLSVGPGGLRSGRLPLQPRVQLDERGRQRGDFSLWLRPARRADAGEYRAAVHLRDRALSCRLRLRLGQASMTASPPGSLRASDWVILNCSFSRPDRPASVHWFRNRGQGRVPVRESPHHHLAESFLFLPQVSPMDSGPWGCILTYRDGFNVSIMYNLTVLGLEPPTPLTVYAGAGSRVGLPCRLPAGVGTRSFLTAKWTPPGGGPDLLVTGDNGDFTLRLEDVSQAQAGTYTCHIHLQEQQLNATVTLAIITVTPKSFGSPGSLGKLLCEVTPVSGQERFVWSSLDTPSQRSFSGPWLEAQEAQLLSQPWQCQLYQGERLLGAAVYFTELSSPGAQRSGRAPGALPAGHLLLFLILGVLSLLLLVTGAFGFHLWRRQWRPRRFSALEQGIHPPQAQSKIEELEQEPEPEPEPEPEPEPEPEPEQL

SEQ ID NO: 52025 - protein, 339 aa, Homo sapiens
MAEASSDPGAEEREELLGPTAQWSVEDEEEAVHEQCQHERDRQLQAQDEEGGGHVPERPKQEMLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 52026 - protein, 277 aa, Homo sapiens
MLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 52027 - protein, 277 aa, Homo sapiens; identical to SEQ ID NO: 52026

SEQ ID NO: 52028 - protein, 222 aa, Homo sapiens
MLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCK

SEQ ID NO: 52029 - protein, 60 aa, Homo sapiens
MLLSLKPSEAPELDEDEGFGDWSQRPEQRQQHEGAQGALDSGEPPQCRSPEGEQEDRPGL

SEQ ID NO: 52030 - protein, 222 aa, Homo sapiens; identical to SEQ ID NO: 52028

SEQ ID NO: 52031 - protein, 126 aa, Homo sapiens
MLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQS

SEQ ID NO: 52032 - protein, 64 aa, Homo sapiens
MLLSLKPSEAPELDEDEGFGDWSQRPEQRQQHEGAQGALDSGEPPQCRSPEGEQEDRPGLHAYE

SEQ ID NO: 52033 - protein, 467 aa, Homo sapiens
MAPIWSPPGRVSGCHLSSGPAPGSAVGPWLGTPHPSLPLPLAPHKPPPPGLPGSAGQTSLPAQRECVFPGDAAVHQELCGLGFEECLGSIPQAHQCYLTNGPKRRKCSPRRRGRAPAWLCGGSPPCHQGLGHEHPSSGPSTNCSPRPTAQWSVEDEEEAVHEQCQHERDRQLQAQDEEGGGHVPERPKQEMLLSLKPSEAPELDEDEGFGDWSQRPEQRQQHEGAQGALDSGEPPQCRSPEGEQEDRPGLHAYEKEDSDEVHLEELSLSKEGPGPEDTVQDNLGAAGAEEEQEEHQKCQQPRTPSPLVLEGTIEQSSPPLSPTTKLIDRTESLNRSIEKSNSVKKSQPDLPISKIDQWLEQYTQAIETAGRTPKLARQASIELPSMAVASTKSRWETGEVQAQSAAKTPSCKDIVAGDMSKKSLWEQKGGSKTSSTIKSTPSGKRYKFVATGHGKYEKVLVEGGPAP

SEQ ID NO: 52034 - protein, 205 aa, Homo sapiens
MTPPERLFLPRVCGTTLHLLLLGLLLVLLPGAQGLPGVGLTPSAAQTARQHPKMHLAHSNLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 52035 - protein, 205 aa, Homo sapiens; identical to SEQ ID NO: 52034

SEQ ID NO: 52036 - protein, 205 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 52037 - protein, 205 aa, Homo sapiens; identical to SEQ ID NO: 52036

SEQ ID NO: 52038 - protein, 205 aa, Homo sapiens; identical to SEQ ID NO: 52036

SEQ ID NO: 52039 - protein, 205 aa, Homo sapiens
MTPPERLFLPRVRGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQVVFSGKAYSPKATSSPLYLAHEVQLFSSQYPFHVPLLSSQKMVYPGLQEPWLHSMYHGAAFQLTQGDQLSTHTDGIPHLVLSPSTVFFGAFAL

SEQ ID NO: 52040 - protein, 205 aa, Homo sapiens; identical to SEQ ID NO: 52036

SEQ ID NO: 52041 - protein, 138 aa, Homo sapiens
MTPPERLFLPRVCGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQGSSPPLLWPFQQLKSSLIKSPELSKK

SEQ ID NO: 52042 - protein, 205 aa, Homo sapiens; identical to SEQ ID NO: 52039

SEQ ID NO: 52043 - protein, 205 aa, Homo sapiens; identical to SEQ ID NO: 52039

SEQ ID NO: 52044 - protein, 205 aa, Homo sapiens; identical to SEQ ID NO: 52036

SEQ ID NO: 52045 - protein, 205 aa, Homo sapiens; identical to SEQ ID NO: 52036

SEQ ID NO: 52046 - protein, 205 aa, Homo sapiens; identical to SEQ ID NO: 52039

SEQ ID NO: 52047 - protein, 138 aa, Homo sapiens
MTPPERLFLPRVRGTTLHLLLLGLLLVLLPGAQGLPGVGLTPSAAQTARQHPKMHLAHSTLKPAAHLIGDPSKQNSLLWRANTDRAFLQDGFSLSNNSLLVPTSGIYFVYSQGSSPPLLWPFQQLKSSLIKSPELSKK

SEQ ID NO: 52048 - protein, 157 aa, Homo sapiens
MTPPERLFLPRVCGTTLHLLLLGLLLVLLPGAQGLPGVGLTPSAAQTARQHPKMHLAHSNLKPAAHLIGDPSKQNSLLWRANTDRAFLQDGFSLSNNSLLVPTSGIYFVYSQLPEDGVSRAAGTLAALDVPRGCVPAHPGRPAIHPHRWHPPPSPQP

SEQ ID NO: 52049 - protein, 138 aa, Homo sapiens; identical to SEQ ID NO: 52041

SEQ ID NO: 52050 - protein, 138 aa, Homo sapiens; identical to SEQ ID NO: 52041

SEQ ID NO: 52051 - protein, 138 aa, Homo sapiens; identical to SEQ ID NO: 52047

SEQ ID NO: 52052 - protein, 244 aa, Homo sapiens
MGALGLEGRGGRLQGRGSLLLAVAGATSLVTLLLAVPITVLAVLALVPQDQGGLVTETADPGAQAQQGLGFQKLPEEEPETDLSPGLPAAHLIGAPLKGQGLGWETTKEQAFLTSGTQFSDAEGLALPQDGLYYLYCLVGYRGRAPPGGGDPQGRSVTLRSSLYRAGGAYGPGTPELLLEGAETVTPVLDPARRQGYGPLWYTSVGFGGLVQLRRGERVYVNISHPDMVDFARGKTFFGAVMVG

SEQ ID NO: 52053 - protein, 244 aa, Homo sapiens; identical to SEQ ID NO: 52052

SEQ ID NO: 52054 - protein, 244 aa, Homo sapiens; identical to SEQ ID NO: 52052

SEQ ID NO: 52055 - protein, 244 aa, Homo sapiens; identical to SEQ ID NO: 52052

SEQ ID NO: 52056 - protein, 244 aa, Homo sapiens; identical to SEQ ID NO: 52052

SEQ ID NO: 52057 - protein, 244 aa, Homo sapiens; identical to SEQ ID NO: 52052

SEQ ID NO: 52058 - protein, 77 aa, Homo sapiens
MGALGLEGRGGRLQGRGSLLLAVAGATSLVTLLLAVPITVLAVLALVPQDQGGLGFRSCQRRSQKQISAPGSQLPTS

SEQ ID NO: 52059 - protein, 244 aa, Homo sapiens; identical to SEQ ID NO: 52052

SEQ ID NO: 52060 - protein, 244 aa, Homo sapiens; identical to SEQ ID NO: 52052

SEQ ID NO: 52061 - protein, 91 aa, Homo sapiens
MAASSRAQVLSLYRAMLRESKRFSAYNYRTYAVRRIRDAFRENKNVKDPVEIQTLVNKAKRDLGVIRRQVHIGQLYSTDKLIIENRDMPRT

SEQ ID NO: 52062 - protein, 130 aa, Homo sapiens
MAASSRAQVLSLYRAMLRESKRFSAYNYRTYAVRRIRDAFRENKNVKDPVEIQTLVNKAKRDLGVIRRQMDSHSVAQAGVHWNDLSSLQPLPPWFKQFSCLSLPSSWDYRRTPPRLANFCILSRDVISLY

SEQ ID NO: 52063 - protein, 96 aa, Homo sapiens
MAASSRAQVLSLYRAMLRESKRFSAYNYRTYAVRRIRDAFRENKNVKDPVEIQTLVNKAKRDLGVIRRQVAEQGTAARRKSGNSSRSLGKPCTSWP

SEQ ID NO: 52064 - protein, 852 aa, Homo sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 52065 - protein, 876 aa, Homo sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGQAGGLQDDSSGGYGDGQASGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQAERIIVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 52066 - protein, 876 aa, Homo sapiens
MLSGKKAAAAAAAAAAAATGTEAGPGTAGGSENGSEVAAQPAGLSGPAEVGPGAVGERTPRKKEPPRASPPGGLAEPPGSAGPQAGPTVVPGSATPMETGIAETPEGRRTSRRKRAKVEYREMDESLANLSEDEYYSEEERNAKAEKEKKLPPPPPQAPPEEENESEPEEPSGQAGGLQDDSSGGYGDGQASGVEGAAFQSRLPHDRMTSQEAACFPDIISGPQQTQKVFLFIRNRTLQLWLDNPKIQLTFEATLQQLEAPYNSDTVLVHRVHSYLERHGLINFGIYKRIKPLPTKKTGKVIIIGSGVSGLAAARQLQSFGMDVTLLEARDRVGGRVATFRKGNYVADLGAMVVTGLGGNPMAVVSKQVNMELAKIKQKCPLYEANGQADTVKVPKEKDEMVEQEFNRLLEATSYLSHQLDFNVLNNKPVSLGQALEVVIQLQEKHVKDEQIEHWKKIVKTQEELKELLNKMVNLKEKIKELHQQYKEASEVKPPRDITAEFLVKSKHRDLTALCKEYDELAETQGKLEEKLQELEANPPSDVYLSSRDRQILDWHFANLEFANATPLSTLSLKHWDQDDDFEFTGSHLTVRNGYSCVPVALAEGLDIKLNTAVRQVRYTASGCEVIAVNTRSTSQTFIYKCDAVLCTLPLGVLKQQPPAVQFVPPLPEWKTSAVQRMGFGNLNKVVLCFDRVFWDPSVNLFGHVGSTTASRGELFLFWNLYKAPILLALVAGEAAGIMENISDDVIVGRCLAILKGIFGSSAVPQPKETVVSRWRADPWARGSYSYVAAGSSGNDYDLMAQPITPGPSIPGAPQPIPRLFFAGEHTIRNYPATVHGALLSGLREAGRIADQFLGAMYTLPRQATPGVPAQQSPSM

SEQ ID NO: 52067 - protein, 590 aa, Homo sapiens
MATPRGRTKKKASFDHSPDSLPLRSSGRQAKKKATETTDEDEDGGSEKKYRKCEKAGCTATCPVCFASASERCAKNGYTSRWYHLSCGEHFCNECFDHYYRSHKDGYDKYTTWKKIWTSNGKTEPSPKAFMADQQLPYWVQCTKPECRKWRQLTKEIQLTPQIAKTYRCGMKPNTAIKPETSDHCSLPEDLEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQVSARSWDHNEFFAQFAGDHTLLTPGYSVIIEKLAEGLDIQLKSPVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 52068 - protein, 820 aa, Homo sapiens
MATPRGRTKKKASFDHSPDSLPLRSSGRQAKKKATETTDEDEDGGSEKKYRKCEKAGCTATCPVCFASASERCAKNGYTSRWYHLSCGEHFCNECFDHYYRSHKDGYDKYTTWKKIWTSNGKTEPSPKAFMADQQLPYWVQCTKPECRKWRQLTKEIQLTPQIAKTYRCGMKPNTAIKPETSDHCSLPEDLRVLEVSNHWWYSMLILPPLLKDSVAAPLLSAYYPDCVGMSPSCTSTNRAAATGNASPGKLEHSKAALSVHVPGMNRYFQPFYQPNECGKALCVRPDVMELDELYEFPEYSRDPTMYLALRNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVSARSWDHNEFFAQFAGDHTLLTPGYSVIIEKLAEGLDIQLKSPVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 52069 - protein, 823 aa, Homo sapiens
MATPRGRTKKKASFDHSPDSLPLRSSGRQAKKKATETTDEDEDGGSEKKYRKCEKAGCTATCPVCFASASERCAKNGYTSRWYHLSCGEHFCNECFDHYYRSHKDGYDKYTTWKKIWTSNGKTEPSPKAFMADQQLPYWVQCTKPECRKWRQLTKEIQLTPQIAKTYRCGMKPNTAIKPETSDHCSLPEDLRVLEVSNHWWYSMLILPPLLKDSVAAPLLSAYYPDCVGMSPSCTSTNRAAATGNASPGKLEHSKAALSVHVPGMNRYFQPFYQPNECGKALCVRPDVMELDELYEFPEYSRDPTMYLALRNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVSARSWDHNEFFAQFAGDHTLLTPGYSVIIEKLAEGLDIQLKSPQVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 52070 - protein, 591 aa, Homo sapiens
MATPRGRTKKKASFDHSPDSLPLRSSGRQAKKKATETTDEDEDGGSEKKYRKCEKAGCTATCPVCFASASERCAKNGYTSRWYHLSCGEHFCNECFDHYYRSHKDGYDKYTTWKKIWTSNGKTEPSPKAFMADQQLPYWVQCTKPECRKWRQLTKEIQLTPQIAKTYRCGMKPNTAIKPETSDHCSLPEDLEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQVSARSWDHNEFFAQFAGDHTLLTPGYSVIIEKLAEGLDIQLKSPQVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 52071 - protein, 640 aa, Homo sapiens
  MOD_RES (1)..(1): Any amino acid
XCSLPEDLRVLEVSNHWWYSMLILPPLLKDSVAAPLLSAYYPDCVGMSPSCTSTNRAAATGNASPGKLEHSKAALSVHVPGMNRYFQPFYQPNECGKALCVRPDVMELDELYEFPEYSRDPTMYLALRNLILALWYTNCKEALTPQKCIPHIIVRGLVRIRCVQEVERILYFMTRKGLINTGVLSVGADQYLLPKDYHNKSVIIIGAGPAGLAAARQLHNFGIKVTVLEAKDRIGGRVWDDKSFKGVTVGRGAQIVNGCINNPVALMCEQLGISMHKFGERCDLIQEGGRITDPTIDKRMDFHFNALLDVVSEWRKDKTQLQDVPLGEKIEEIYKAFIKESGIQFSELEGQVLQFHLSNLEYACGSNLHQVSARSWDHNEFFAQFAGDHTLLTPGYSVIIEKLAEGLDIQLKSPQVQCIDYSGDEVQVTTTDGTGYSAQKVLVTVPLALLQKGAIQFNPPLSEKKMKAINSLGAGIIEKIALQFPYRFWDSKVQGADFFGHVPPSASKRGLFAVFYDMDPQKKHSVLMSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 52072 - protein, 113 aa, Homo sapiens
MSVIAGEAVASVRTLDDKQVLQQCMATLRELFKEQEVPDPTKYFVTRWSTDPWIQMAYSFVKTGGSGEAYDIIAEDIQGTVFFAGEATNRHFPQTVTGAYLSGVREASKIAAF

SEQ ID NO: 52073 - protein, 1321 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVINGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKASESSFGKP

SEQ ID NO: 52074 - protein, 1321 aa, Homo sapiens; identical to SEQ ID NO: 52073

SEQ ID NO: 52075 - protein, 1321 aa, Homo sapiens; identical to SEQ ID NO: 52073

SEQ ID NO: 52076 - protein, 170 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEF

SEQ ID NO: 52077 - protein, 711 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVINGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGENRFDSPPAPLHS

SEQ ID NO: 52078 - protein, 121 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLD

SEQ ID NO: 52079 - protein, 1327 aa, Homo sapiens
MVLTLGESWPVLVGRRFLSLSAADGSDGSHDSWDVERVAEWPWLSGTIRAVSHTDVTKKDLKVCVEFDGESWRKRRWIEVYSLLRRAFLVEHNLVLAERKSPEISERIVQWPAITYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVINGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKVNPVLANLNLPAHWK

SEQ ID NO: 52080 - protein, 1269 aa, Homo sapiens
MVLTLGESWPVLVGRRFLSLSAADGSDGSHDSWDVERVAEWPWLSGTIRAVSHTDVTKKDLKTYKPLLDKAGLGSITSVRFLGDQQRVFLSKDLLKPIQDVNSLRLSLTDNQIVSKEFQALIVKHLDESHLLKGDKNLVGSEVKIYSLDPSTQWFSATVINGNPASKTLQVNCEEIPALKIVDPSLIHVEVVHDNLVTCGNSARIGAVKRKSSENNGTLVSKQAKSCSEASPSMCPVQSVPTTVFKEILLGCTAATPPSKDPRQQSTPQAANSPPNLGAKIPQGCHKQSLPEEISSCLNTKSEALRTKPDVCKAGLLSKSSQIGTGDLKILTEPKGSCTQPKTNTDQENRLESVPQALTGLPKECLPTKASSKAELEIANPPELQKHLEHAPSPSDVSNAPEVKAGVNSDSPNNCSGKKVEPSALACRSQNLKESSVKVDNESCCSRSNNKIQNAPSRKSVLTDPAKLKKLQQSGEAFVQDDSCVNIVAQLPKCRECRLDSLRKDKEQQKDSPVFCRFFHFRRLQFNKHGVLRVEGFLTPNKYDNEAIGLWLPLTKNVVGIDLDTAKYILANIGDHFCQMVISEKEAMSTIEPHRQVAWKRAVKGVREMCDVCDTTIFNLHWVCPRCGFGVCVDCYRMKRKNCQQGAAYKTFSWLKCVKSQIHEPENLMPTQIIPGKALYDVGDIVHSVRAKWGIKANCPCSNRQFKLFSKPASKEDLKQTSLAGEKPTLGAVLQQNPSVLEPAAVGGEAASKPAGSMKPACPASTSPLNWLADLTSGNVNKENKEKQPTMPILKNEIKCLPPLPPLSKSSTVLHTFNSTILTPVSNNNSGFLRNLLNSSTGKTENGLKNTPKILDDIFASLVQNKTTSDLSKRPQGLTIKPSILGFDTPHYWLCDNRLLCLQDPNNKSNWNVFRECWKQGQPVMVSGVHHKLNSELWKPESFRKEFGEQEVDLVNCRTNEIITGATVGDFWDGFEDVPNRLKNEKEPMVLKLKDWPPGEDFRDMMPSRFDDLMANIPLPEYTRRDGKLNLASRLPNYFVRPDLGPKMYNAYGLITPEDRKYGTTNLHLDVSDAANVMVYVGIPKGQCEQEEEVLKTIQDGDSDELTIKRFIEGKEKPGALWHIYAAKDTEKIREFLKKVSEEQGQENPADHDPIHDQSWYLDRSLRKRLHQEYGVQGWAIVQFLGDVVFIPAGAPHQVHNLYSCIKVAEDFVSPEHVKHCFWLTQEFRYLSQTHTNHEDKLQVKNVIYHAVKDAVAMLKASESSFGKP

SEQ ID NO: 52081 - protein, 1761 aa, Homo sapiens
MADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSAPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 52082 - protein, 1417 aa, Homo sapiens
MGAMEINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 52083 - protein, 793 aa, Homo sapiens
MNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 52084 - protein, 1551 aa, Homo sapiens
GWRWLYGVVSHQDSITRLMEVSVTESGEIKSVDPRLIHVMLMDNSAPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 52085 - protein, 715 aa, Homo sapiens
MAGVGPGGYAAEFVPPPECPVFEPSWEEFTDPLSFIGRIRPLAEKTGICKIRPPKEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKEL

SEQ ID NO: 52086 - protein, 1636 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKGVVFVTEEEKNKKY

SEQ ID NO: 52087 - protein, 1049 aa, Homo sapiens
MAGVGPGGYAAEFVPPPECPVFEPSWEEFTDPLSFIGRIRPLAEKTGICKIRPPKDWQPPFACEVKSFRFTPRVQRLNELEIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRR

SEQ ID NO: 52088 - protein, 1690 aa, Homo sapiens
MAGVGPGGYAAEFVPPPECPVFEPSWEEFTDPLSFIGRIRPLAEKTGICKIRPPKDWQPPFACEVKSFRFTPRVQRLNELEAMTRVRLDFLDQLAKFWELQGSTLKIPVVERKILDLYALSKIVASKGGFEMVTKEKKWSKVGSRLGYLPGKGTGSLLKSHYERILYPYELFQSGVSLMGVQMPNLDLKEKVEPEVLSTDTQTSPEPGTRMNILPKRTRRVKTQSESGDVSRNTELKKLQIFGAGPKVVGLAMGTKDKEDEVTRRRKVTNRSDAFNMQMRQRKGTLSVNFVDLYVCMFCGRGNNEDKLLLCDGCDDSYHTFCLIPPLPDVPKGDWRCPKCVAEECSKPREAFGFEQAVREYTLQSFGEMADNFKSDYFNMPVHMVPTELVEKEFWRLVSSIEEDVIVEYGADISSKDFGSGFPVKDGRRKILPEEEEYALSGWNLNNMPVLEQSVLAHINVDISGMKVPWLYVGMCFSSFCWHIEDHWSYSINYLHWGEPKTWYGVPSHAAEQLEEVMRELAPELFESQPDLLHQLVTIMNPNVLMEHGVPVYRTNQCAGEFVVTFPRAYHSGFNQGYNFAEAVNFCTADWLPIGRQCVNHYRRLRRHCVFSHEELIFKMAADPECLDVGLAAMVCKELTLMTEEETRLRESVVQMGVLMSEEEVFELVPDDERQCSACRTTCFLSALTCSCNPERLVCLYHPTDLCPCPMQKKCLRYRYPLEDLPSLLYGVKVRAQSYDTWVSRVTEALSANFNHKKDLIELRVMLEDAEDRKYPENDLFRKLRDAVKEAETCASVAQLLLSKKQKHRQSPDSGRTRTKLTVEELKAFVQQLFSLPCVISQARQVKNLLDDVEEFHERAQEAMMDETPDSSKLQMLIDMGSSLYVELPELPRLKQELQQARWLDEVRLTLSDPQQVTLDVMKKLIDSGVGLAPHHAVEKAMAELQELLTVSERWEEKAKVCLQARPRHSVASLESIVNEAKNIPAFLPNVLSLKEALQKAREWTAKVEAIQSGSNYAYLEQLESLSAKGRPIPVRLEALPQVESQVAAARAWRERTGRTFLKKNSSHTLLQVLSPRTDIGVYGSGKNRRKKVKELIEKEKEKDLDLEPLSDLEEGLEETRDTAMVVAVFKEREQKEIEAMHSLRAANLAKMTMVDRIEEVKFCICRKTASGFMLQCELCKDWFHNSCVPLPKSSSQKKGSSWQAKEVKFLCPLCMRSRRPRLETILSLLVSLQKLPVRLPEGEALQCLTERAMSWQDRARQALATDELSSALAKLSVLSQRMVEQAAREKTEKIISAELQKAAANPDLQGHLPSFQQSAFNRVVSSVSSSPRQTMDYDDEETDSDEDIRETYGYDMKDTASVKSSSSLEPNLFCDEEIPIKSEEVVTHMWTAPSFCAEHAYSSASKSCSQGSSTPRKQPRKSPLVPRSLEPPVLELSPGAKAQLEELMMVGDLLEVSLDETQHIWRILQATHPPSEDRFLHIMEDDSMEEKPLKVKGKDSSEKKRKRKLEKVEQLFGEGKQKSKELKKMDKPRKKKLKLGADKSKELNKLAKKLAKEEERKKKKEKAAAAKVELVKESTEKKREKKVLDIPSKYDWSGAEESDDENAVCAAQNCQRPCKDKVDWVQCDGGCDEWFHQVCVGVSPEMAENEDYICINCAKKQGPVSPGPAPPPSFIMSYKLPMEDLKETS

SEQ ID NO: 52089 - protein, 1275 aa, Homo sapiens
MGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTP

SEQ ID NO: 52090 - protein, 1580 aa, Homo sapiens
MEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAERQSLAVLPRLECSGAILAHCNLRLLDSSNSSASASQAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 52091 - protein, 1544 aa, Homo sapiens
MEAATTLHPGPRPALPLGGPGPLGEFLPPPECPVFEPSWEEFADPFAFIHKIRPIAEQTGICKVRPPPDWQPPFACDVDKLHFTPRIQRLNELEAQTRVKLNFLDQIAKYWELQGSTLKIPHVERKILDLFQLNKLVAEEGGFAVVCKDRKWTKIATKMGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 52092 - protein, 1386 aa, Homo sapiens
MGFAPGKAVGSHIRGHYERILNPYNLFLSGDSLRCLQKPNLTTDTKDKEYKPHDIPQRQSVQPSETCPPARRAKRMRAEAMNIKIEPEETTEARTHNLRRRMGCPTPKCENEKEMKSSIKQEPIERKDYIVENEKEKPKSRSKKATNAVDLYVCLLCGSGNDEDRLLLCDGCDDSYHTFCLIPPLHDVPKGDWRCPKCLAQECSKPQEAFGFEQAARDYTLRTFGEMADAFKSDYFNMPVHMVPTELVEKEFWRLVSTIEEDVTVEYGADIASKEFGSGFPVRDGKIKLSPEEEEYLDSGWNLNNMPVMEQSVLAHITADICGMKLPWLYVGMCFSSFCWHIEDHWSYSINYLHWGEPKTWYGVPGYAAEQLENVMKKLAPELFVSQPDLLHQLVTIMNPNTLMTHEVPVYRTNQCAGEFVITFPRAYHSGFNQGFNFAEAVNFCTVDWLPLGRQCVEHYRLLHRYCVFSHDEMICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRRLIDLGVGLAPYSAVEKAMARLQELLTVSEHWDDKAKSLLKARPRHSLNSLATAVKEIEEIPAYLPNGAALKDSVQRARDWLQDVEGLQAGGRVPVLDTLIELVTRGRSIPVHLNSLPRLETLVAEVQAWKECAVNTFLTENSPYSLLEVLCPRCDIGLLGLKRKQRKLKEPLPNGKKKSTKLESLSDLERALTESKETASAMATLGEARLREMEALQSLRLANEGKLLSPLQDVDIKICLCQKAPAAPMIQCELCRDAFHTSCVAVPSISQGLRIWLCPHCRRSEKPPLEKILPLLASLQRIRVRLPEGDALRYMIERTVNWQHRAQQLLSSGNLKFVQDRVGSGLLYSRWQASAGQVSDTNKVSQPPGTTSFSLPDDWDNRTSYLHSPFSTGRSCIPLHGVSPEVNELLMEAQLLQVSLPEIQELYQTLLAKPSPAQQTDRSSPVRPSSEKNDCCRGKRDGINSLERKLKRRLEREGLSSERWERVKKMRTPKKKKIKLSHPKDMNNFKLERERSYELVRSAETHSLPSDTSYSEQEDSEDEDAICPAVSCLQPEGDEVDWVQCDGSCNQWFHQVCVGVSPEMAEKEDYICVRCTVKDAPSRK

SEQ ID NO: 52093 - protein, 310 aa, Homo sapiens
MICKMASKADVLDVVVASTVQKDMAIMIEDEKALRETVRKLGVIDSERMDFELLPDDERQCVKCKTTCFMSAISCSCKPGLLVCLHHVKELCSCPPYKYKLRYRYTLDDLYPMMNALKLRAESYNEWALNVNEALEAKINKKKSLVSFKALIEESEMKKFPDNDLLRHLRLVTQDAEKCASVAQQLLNGKRQTRYRSGGGKSQNQLTVNELRQFVTQLYALPCVLSQTPLLKDLLNRVEDFQQHSQKLLSEETPSAAELQDLLDVSFEFDVELPQLAEMRIRLEQARWLEEVQQACLDPSSLTLDDMRVS

SEQ ID NO: 52094 - protein, 1557 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 52095 - protein, 1516 aa, Homo sapiens
MEPGSDDFLPPPECPVFEPSWAEFRDPLGYIAKIRPIAEKSGICKIRPPADWQPPFAVEVDNFRFTPRIQRLNELEIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 52096 - protein, 1560 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 52097 - protein, 1559 aa, Homo sapiens
MEPGSDDFLPPPECPVFEPSWAEFRDPLGYIAKIRPIAEKSGICKIRPPADWQPPFAVEVDNFRFTPRIQRLNELEAQTRVKLNYLDQIAKFWEIQGSSLKIPNVERRILDLYSLSKIVVEEGGYEAICKDRRWARVAQRLNYPPGKNIGSLLRSHYERIVYPYEMYQSGANLVCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSGKRDLELLSSLLPQLTGPVLELPEATRAPLEELMMEGDLLEVTLDENHSIWQLLQAGQPPDLERIRTLLELEKAERHGSRARGRALERRRRRKVDRGGEGDDPAREELEPKRVRSSGPEAEEVQEEEELEEETGGEGPPAPIPTTGSPSTQENQNGLEPAEGTTSGPSAPFSTLTPRLHLPCPQQPPQQQL

SEQ ID NO: 52098 - protein, 1379 aa, Homo sapiens
MEPGSDDFLPPPECPVFEPSWAEFRDPLGYIAKIRPIAEKSGICKIRPPAIVVEEGGYEAICKDRRWARVAQRLNYPPGKNIGSLLRSHYERIVYPYEMYQSGANLVQCNTRPFDNEEKDKEYKPHSIPLRQSVQPSKFNSYGRRAKRLQPDPEPTEEDIEKNPELKKLQIYGAGPKMMGLGLMAKDKTLRKKDKEGPECPPTVVVKEELGGDVKVESTSPKTFLESKEELSHSPEPCTKMTMRLRRNHSNAQFIESYVCRMCSRGDEDDKLLLCDGCDDNYHIFCLLPPLPEIPKGVWRCPKCVMAECKRPPEAFGFEQATREYTLQSFGEMADSFKADYFNMPVHMVPTELVEKEFWRLVNSIEEDVTVEYGADIHSKEFGSGFPVSDSKRHLTPEEEEYATSGWNLNVMPVLEQSVLCHINADISGMKVPWLYVGMVFSAFCWHIEDHWSYSINYLHWGEPKTWYGVPSLAAEHLEEVMKKLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAACPEKLDLNLAAAVHKEMFIMVQEERRLRKALLEKGITEAEREAFELLPDDERQCIKCKTTCFLSALACYDCPDGLVCLSHINDLCKCSSSRQYLRYRYTLDELPAMLHKLKVRAESFDTWANKVRVALEVEDGRKRSLEELRALESEARERRFPNSELLQQLKNCLSEAEACVSRALGLVSGQEAGPHRVAGLQMTLTELRAFLDQMNNLPCAMHQIGDVKGVLEQVEAYQAEAREALASLPSSPGLLQSLLERGRQLGVEVPEAQQLQRQVEQARWLDEVKRTLAPSARRGTLAVMRGLLVAGASVAPSPAVDKAQAELQELLTIAERWEEKAHLCLEARQKHPPATLEAIIREAENIPVHLPNIQALKEALAKARAWIADVDEIQNGDHYPCLDDLEGLVAVGRDLPVGLEELRQLELQVLTAHSWREKASKTFLKKNSCYTLLEVLCPCADAGSDSTKRSRWMEKELGLYKSDTELLGLSAQDLRDPGSVIVAFKEGEQKEKEGILQLRRTNSAKPSPLASSSTASSTTSICVCGQVLAGAGALQCDLCQDWFHGRCVSVPRLLSSPRPNPTSSPLLAWWEWDTKFLCPLCMRSRRPRLETILALLVALQRLPVRLPEGEALQCLTERAISWQGRARQALASEDVTALLGRLAELRQRLQAEPRPEEPPNYPAAPASDPLREGSGKDMPKVQGLLENGDSVTSPEKVAPEEGSDLELLSSLLPQLTGPVLELPEATRAPLEELMMEGDLLEVTLDENHSIPESLDFCILTPRYCSDLSSWGPAPGVFPPW

SEQ ID NO: 52099 - protein, 1539 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 52100 - protein, 1482 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 52101 - protein, 293 aa, Homo sapiens
LPNIQALKEALTKAQAWIADVDEIQNGDHYPCLDDLEGLVAVGRDLPVGLEELRQLELQVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACD

SEQ ID NO: 52102 - protein, 1476 aa, Homo sapiens
MEPGCDEFLPPPECPVFEPSWAEFQDPLGYIAKIRPIAEKSGICKIRPPADWQPPFAVEVDNFRFTPRVQRLNELEIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSG

SEQ ID NO: 52103 - protein, 425 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMP

SEQ ID NO: 52104 - protein, 888 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKVLSWKWRRYVFPYHLCVYSMQGNILPD

SEQ ID NO: 52105 - protein, 1570 aa, Homo sapiens
MEPGCDEFLPPPECPVFEPSWAEFQDPLGYIAKIRPIAEKSGICKIRPPADWQPPFAVEVDNFRFTPRVQRLNELEAQTRVKLNYLDQIAKFWEIQGSSLKIPNVERKILDLYSLSKIVIEEGGYEAICKDRRWARVAQRLHYPPGKNIGSLLRSHYERIIYPYEMFQSGANHVQCNTHPFDNEVKDKEYKPHSIPLRQSVQPSKFSSYSRRAKRLQPDPEPTEEDIEKHPELKKLQIYGPGPKMMGLGLMAKDKDKTVHKKVTCPPTVTVKDEQSGGGNVSSTLLKQHLSLEPCTKTTMQLRKNHSSAQFIDSYICQVCSRGDEDDKLLFCDGCDDNYHIFCLLPPLPEIPRGIWRCPKCILAECKQPPEAFGFEQATQEYSLQSFGEMADSFKSDYFNMPVHMVPTELVEKEFWRLVSSIEEDVTVEYGADIHSKEFGSGFPVSNSKQNLSPEEKRQSLTVLTRLISSFWAQAVLPPWPPKVLGLQEYATSGWNLNVMPVLDQSVLCHINADISGMKVPWLYVGMVFSAFCWHIEDHWSYSINYLHWGEPKTWYGVPSLAAEHLEEVMKMLTPELFDSQPDLLHQLVTLMNPNTLMSHGVPVVRTNQCAGEFVITFPRAYHSGFNQGYNFAEAVNFCTADWLPAGRQCIEHYRRLRRYCVFSHEELICKMAAFPETLDLNLAVAVHKEMFIMVQEERRLRKALLEKGVTEAEREAFELLPDDERQCIKCKTTCFLSALACYDCPDGLVCLSHINDLCKCSSSRQYLRYRYTLDELPTMLHKLKIRAESFDTWANKVRVALEVEDGRKRSFEELRALESEARERRFPNSELLQRLKNCLSEVEACIAQVLGLVSGQVARMDTPQLTLTELRVLLEQMGSLPCAMHQIGDVKDVLEQVEAYQAEAREALATLPSSPGLLRSLLERGQQLGVEVPEAHQLQQQVEQAQWLDEVKQALAPSAHRGSLVIMQGLLVMGAKIASSPSVDKARAELQELLTIAERWEEKAHFCLEARQKHPPATLEAIIRETENIPVHLPNIQALKEALTKAQAWIADVDEIQNGDHYPCLDDLEGLVAVGRDLPVGLEELRQLELQVLTAHSWREKASKTFLKKNSCYTLLEVLCPCADAGSDSTKRSRWMEKALGLYQCDTELLGLSAQDLRDPGSVIVAFKEGEQKEKEGILQLRRTNSAKPSPLAPSLMASSPTSICVCGQVPAGVGVLQCDLCQDWFHGQCVSVPHLLTSPKPSLTSSPLLAWWEWDTKFLCPLCMRSRRPRLETILALLVALQRLPVRLPEGEALQCLTERAIGWQDRARKALASEDVTALLRQLAELRQQLQAKPRPEEASVYTSATACDPIREGSGNNISKVQGLLENGDSVTSPENMAPGKGSDLELLSSLLPQLTGPVLELPEAIRAPLEELMMEGDLLEVTLDENHSIWQLLQAGQPPDLDRIRTLLELEKFEHQGSRTRSRALERRRRRQKVDQGRNVENLVQQELQSKRARSSGIMSQVGREEEHYQEKADRENMFLTPSTDHSPFLKGNQNSLQHKDSGSSAACPSLMPLLQLSYSDEQQL

SEQ ID NO: 52106 - protein, 1098 aa, Homo sapiens
MDLGTLYESCNQPQDAIKCYLNATRSKSCSNTSALAARIKYLQAQLCNLPQGSLQNKTKLLPSIEEAWSLPIPAELTSRQGAMNTAQQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52107 - protein, 1401 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52108 - protein, 1408 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52109 - protein, 999 aa, Homo sapiens
  MOD_RES (1)..(1): Any amino acid
XGTLYESCNQPQDAIKCYLNATRSKSCSNTSALAARIKYLQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52110 - protein, 161 aa, Homo sapiens
  MOD_RES (1)..(1): Any amino acid
XARNIKVSDPKLFEMIKIFSLSPNFRAEKCLRDHLVQPLRSNGEPEPLRFTGEYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52111 - protein, 1044 aa, Homo sapiens
  MOD_RES (1)..(1): Any amino acid
XNKTKLLPSIEEAWSLPIPAELTSRQGAMNTAQQACKPHHPNTEPVLGLSQTPISQQSLPLHMIPSSQVDDLSSPAKRKRTSSPTKNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52112 - protein, 224 aa, Homo sapiens
  MOD_RES (1)..(1): Any amino acid
XLQAYICAVQLDHGHAAAWMDLGTLYESCNQPQDAIKCYLNATRSKSCSNTSALAARIKYLQAQLCNLPQGSLQNKTKLLPSIEEAWSLPIPAELTSRQGAMNTAQQNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIG

SEQ ID NO: 52113 - protein, 171 aa, Homo sapiens
SLQNKTKLLPSIEEAWSLPIPAELTSRQGAMNTAQQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFCRPCSL

SEQ ID NO: 52114 - protein, 1356 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQNTSDNWSGGHAVSHPPVQQQAHSWCLTPQKLQHLEQLRANRNNLNPAQKLMLEQLESQFVLMQQHQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52115 - protein, 224 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQVGCITL

SEQ ID NO: 52116 - protein, 1322 aa, Homo sapiens
MKSCGVSLATAAAAAAAFGDEEKKMAAGKASGESEEASPSLTAEEREALGGLDSRLFGFVRFHEDGARTKALLGKAVRCYESLILKAEGKVESDFFCQLGHFNLLLEDYPKALSAYQRYYSLQSDYWKNAAFLYGLGLVYFHYNAFQWAIKAFQEVLYVDPSFCRAKEIHLRLGLMFKVNTDYESSLKHFQLALVDCNPCTLSNAEIQFHIAHLYETQRKYHSAKEAYEQLLQTENLSAQVKATVLQQLGWMHHTVDLLGDKATKESYAIQYLQKSLEADPNSGQSWYFLGRCYSSIGKVQDAFISYRQSIDKSEASADTWCSIGVLYQQQNQPMDALQAYICAVQLDHGHAAAWMDLGTLYESCNQPQDAIKCYLNATRSKSCSNTSALAARIKYLQNTSDNWSGGHAVSHPPVQQQAHSWCLTPQKLQMRPTGVAQVRSTGIPNGPTADSSLPTNSVSGQQPQLALTRVPSVSQPGVRPACPGQPLANGPFSAGHVPCSTSRTLGSTDTILIGNNHITGSGSNGNVPYLQRNALTLPHNRTNLTSSAEEPWKNQLSNSTQGLHKGQSSHSAGPNGERPLSSTGPSQHLQAAGSGIQNQNGHPTLPSNSVTQGAALNHLSSHTATSGGQQGITLTKESKPSGNILTVPETSRHTGETPNSTASVEGLPNHVHQMTADAVCSPSHGDSKSPGLLSSDNPQLSALLMGKANNNVGTGTCDKVNNIHPAVHTKTDNSVASSPSSAISTATPSPKSTEQTTTNSVTSLNSPHSGLHTINGEGMEESQSPMKTDLLLVNHKPSPQIIPSMSVSIYPSSAEVLKACRNLGKNGLSNSSILLDKCPPPRPPSSPYPPLPKDKLNPPTPSIYLENKRDAFFPPLHQFCTNPNNPVTVIRGLAGALKLDLGLFSTKTLVEANNEHMVEVRTQLLQPADENWDPTGTKKIWHCESNRSHTTIAKYAQYQASSFQESLREENEKRSHHKDHSDSESTSSDNSGRRRKGPFKTIKFGTNIDLSDDKKWKLQLHELTKLPAFVRVVSAGNLLSHVGHTILGMNTVQLYMKVPGSRTPGHQENNNFCSVNINIGPGDCEWFVVPEGYWGVLNDFCEKNNLNFLMGSWWPNLEDLYEANVPVYRFIQRPGDLVWINAGTVHWVQAIGWCNNIAWNVGPLTACQYKLAVERYEWNKLQSVKSIVPMVHLSWNMARNIKVSDPKLFEMIKYCLLRTLKQCQTLREALIAAGKEIIWHGRTKEEPAHYCSICEVEVFDLLFVTNESNSRKTYIVHCQDCARKTSGNLENFVVLEQYKMEDLMQVYDQFTLAPPLPSASS

SEQ ID NO: 52117 - protein, 1682 aa, Homo sapiens
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLVRARRARGQRRRALGQAAGTGFGSPAAPFPEPPPAFSPQAPASTSR

SEQ ID NO: 52118 - protein, 1643 aa, Homo sapiens
MHRAVDPPGARAAREAFALGGLSCAGAWSSCPPHPPPRSAWLPGGRCSASIGQPPLPAPLPPSHGSSSGHPSKPYYAPGAPTPRPLHGKLESLHGCVQALLREPAQPGLWEQLGQLYESEHDSEEATRCYHSALRYGGSFAELGPRIGRLQQAQLWNFHTGSCQHRAKVLPPLEQVWNLLHLEHKRNYGAKRGGPPVKRAAEPPVVQPVPPAALSGPSGEEGLSPGGKRRRGCNSEQTGLPPGLPLPPPPLPPPPPPPPPPPPPLPGLATSPPFQLTKPGLWSTLHGDAWGPERKGSAPPERQEQRHSLPHPYPYPAPAYTAHPPGHRLVPAAPPGPGPRPPGAESHGCLPATRPPGSDLRESRVQRSRMDSSVSPAATTACVPYAPSRPPGLPGTTTSSSSSSSSNTGLRGVEPNPGIPGADHYQTPALEVSHHGRLGPSAHSSRKPFLGAPAATPHLSLPPGPSSPPPPPCPRLLRPPPPPAWLKGPACRAAREDGEILEELFFGTEGPPRPAPPPLPHREGFLGPPASRFSVGTQDSHTPPTPPTPTTSSSNSNSGSHSSSPAGPVSFPPPPYLARSIDPLPRPPSPAQNPQDPPLVPLTLALPPAPPSSCHQNTSGSFRRPESPRPRVSFPKTPEVGPGPPPGPLSKAPQPVPPGVGELPARGPRLFDFPPTPLEDQFEEPAEFKILPDGLANIMKMLDESIRKEEEQQQHEAGVAPQPPLKEPFASLQSPFPTDTAPTTTAPAVAVTTTTTTTTTTTATQEEEKKPPPALPPPPPLAKFPPPSQPQPPPPPPPSPASLLKSLASVLEGQKYCYRGTGAAVSTRPGPLPTTQYSPGPPSGATALPPTSAAPSAQGSPQPSASSSSQFSTSGGPWARERRAGEEPVPGPMTPTQPPPPLSLPPARSESEVLEEISRACETLVERVGRSATDPADPVDTAEPADSGTERLLPPAQAKEEAGGVAAVSGSCKRRQKEHQKEHRRHRRACKDSVGRRPREGRAKAKAKVPKEKSRRVLGNLDLQSEEIQGREKSRPDLGGASKAKPPTAPAPPSAPAPSAQPTPPSASVPGKKAREEAPGPPGVSRADMLKLRSLSEGPPKELKIRLIKVESGDKETFIASEVEERRLRMADLTISHCAADVVRASRNAKVKGKFRESYLSPAQSVKPKINTEEKLPREKLNPPTPSIYLESKRDAFSPVLLQFCTDPRNPITVIRGLAGSLRLNLGLFSTKTLVEASGEHTVEVRTQVQQPSDENWDLTGTRQIWPCESSRSHTTIAKYAQYQASSFQESLQEEKESEDEESEEPDSTTGTPPSSAPDPKNHHIIKFGTNIDLSDAKRWKPQLQELLKLPAFMRVTSTGNMLSHVGHTILGMNTVQLYMKVPGSRTPGHQENNNFCSVNINIGPGDCEWFAVHEHYWETISAFCDRHGVDYLTGSWWPILDDLYASNIPVYRFVQRPGDLVWINAGTVHWVQATGWCNNIAWNVGPLTAYQYQLALERYEWNEVKNVKSIVPMIHVSWNVARTVKISDPDLFKMIKFCLLQSMKHCQVQRESLVRAGKKIAYQGRVKDEPAYYCNECDVEVFNILFVTSENGSRNTYLVHCEGCARRRSAGLQGVVVLEQYRTEELAQAYDAFTLAPASTSR

SEQ ID NO: 52119 - protein, 414 aa, Homo sapiens [sequence omitted]

SEQ ID NO: 52120 - protein, 308 aa, Homo sapiens
MHSRGREIVVLLNPWSINEAVSSYCTYFIKQDSKSFGIMVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRKWKDDKSHFEDMIDYFCDIHEPLQLLIFPEGTDLTENSKSRSNAFAEKNGLQKYEYVLHPRTTGFTFVVDRLREGRRQSEGSKGPLQGELQITAQGNQRGHKQMEKHSMLMDWKNQYREIGHTAQSNLQIQCYSH

SEQ ID NO: 52121 - protein, 308 aa, Homo sapiens; identical to SEQ ID NO: 52120

SEQ ID NO: 52122 - protein, 376 aa, Homo sapiens
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRKWKDDKSHFEDMIDYFCDIHEPLQLLIFPEGTDLTENSKSRSNAFAEKNGLQKYEYVLHPRTTGFTFVVDRLREGKNLDAVHDITVAYPHNIPQSEKHLLQGDFPREIHFHVHRYPIDTLPTSKEDLQLWCHKRWEEKEERLRSFYQGEKNFYFTGQSVIPPCKSELRVLVVKLLSILYWTLFSPAMCLLIYLYSLVKWYFIITIVIFVLQERIFGGLEIIELACYRLLHKQPHLNSKKNE

SEQ ID NO: 52123 - protein, 330 aa, Homo sapiens
MVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASLKGVPGFGWAMQAAAYIFIHRKWKDDKSHFEDMIDYFCDIHEPLQLLIFPEGTDLTENSKSRSNAFAEKNGLQKYEYVLHPRTTGFTFVVDRLREGKNLDAVHDITVAYPHNIPQSEKHLLQGDFPREIHFHVHRYPIDTLPTSKEDLQLWCHKRWEEKEERLRSFYQGEKNFYFTGQSVIPPCKSELRVLVVKLYTVLDPVQPCNVPTHIFVQSC

SEQ ID NO: 52124 - protein, 153 aa, Homo sapiens
MHSRGREIVVLLNPWSINEAVSSYCTYFIKQDSKSFGIMVSWKGIYFILTLFWGSFFGSIFMLSPFLPLMFVNPSWYRWINNRLVATWLTLPVALLETMFGVKVIITGDAFVPGERSVIIMNHRTRMDWMFLWNCLMRYSYLRLEKICLKASL

SEQ ID NO: 52125 - protein, 376 aa, Homo sapiens; identical to SEQ ID NO: 52122

SEQ ID NO: 52126 - protein, 364 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 52127 - protein, 364 aa, Homo sapiens; identical to SEQ ID NO: 52126

SEQ ID NO: 52128 - protein, 364 aa, Homo sapiens; identical to SEQ ID NO: 52126

SEQ ID NO: 52129 - protein, 182 aa, Homo sapiens
MAAISTSIPVISQPQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIP

SEQ ID NO: 52130 - protein, 346 aa, Homo sapiens
MNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 52131 - protein, 365 aa, Homo sapiens
MEEGAQRSGALGAPHQFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 52132 - protein, 365 aa, Homo sapiens
MLLLLIPAHSSVLENEFTAMNEPQCFYNESIAFFYNRSGKHLATEWNTVSKLVMGLGITVCIFIMLANLLVMVAIYVNRRFHFPIYYLMANLAAADFFAGLAYFYLMFNTGPNTRRLTVSTWLLRQGLIDTSLTASVANLLAIAIERHITVFRMQLHTRMSNRRVVVVIVVIWTMAIVMGAIPSVGWNCICDIENCSNMAPLYSDSYLVFWAIFNLVTFVVMVVLYAHIFGYVRQRTMRMSRHSSGPRRNRDTMMSLLKTVVIVLGAFIICWTPGLVLLLLDVCCPQCDVLAYEKFFLLLAEFNSAMNPIIYSYRDKEMSATFRQILCCQRSENPTGPTEGSDRSASSLNHTILAGVHSNDHSVV

SEQ ID NO: 52133 - protein, 351 aa, Homo sapiens
MVIMGQCYYNETIGFFYNNSGKELSSHWRPKDVVVVALGLTVSVLVLLTNLLVIAAIASNRRFHQPIYYLLGNLAAADLFAGVAYLFLMFHTGPRTARLSLEGWFLRQGLLDTSLTASVATLLAIAVERHRSVMAVQLHSRLPRGRVVMLIVGVWVAALGLGLLPAHSWHCLCALDRCSRMAPLLSRSYLAVWALSSLLVFLLMVAVYTRIFFYVRRRVQRMAEHVSCHPRYRETTLSLVKTVVIILGAFVVCWTPGQVVLLLDGLGCESCNVLAVEKYFLLLAEANSLVNAAVYSCRDAEMRRTFRRLLCCACLRQSTRESVHYTSSAQGGASTRIMLPENGHPLMDSTL

SEQ ID NO: 52134 - protein, 351 aa, Homo sapiens; identical to SEQ ID NO: 52133

SEQ ID NO: 52135 - protein, 353 aa, Homo sapiens
MNECHYDKHMDFFYNRSNTDTVDDWTGTKLVIVLCVGTFFCLFIFFSNSLVIAAVIKNRKFHFPFYYLLANLAAADFFAGIAYVFLMFNTGPVSKTLTVNRWFLRQGLLDSSLTASLTNLLVIAVERHMSIMRMRVHSNLTKKRVTLLILLVWAIAIFMGAVPTLGWNCLCNISACSSLAPIYSRSYLVFWTVSNLMAFLIMVVVYLRIYVYVKRKTNVLSPHTSGSISRRRTPMKLMKTVMTVLGAFVVCWTPGLVVLLLDGLNCRQCGVQHVKRWFLLLALLNSVVNPIIYSYKDEDMYGTMKKMICCFSQENPERRPSRIPSTVLSRSDTGSQYIEDSISQGAVCNKSTS

SEQ ID NO: 52136 - protein, 353 aa, Homo sapiens; identical to SEQ ID NO: 52135

SEQ ID NO: 52137 - protein, 370 aa, Homo sapiens
MGDRRFIDFQFQDSNSSLRPRLGNATANNTCIVDDSFKYNLNGAVYSVVFILGLITNSVSLFVFCFRMKMRSETAIFITNLAVSDLLFVCTLPFKIFYNFNRHWPFGDTLCKISGTAFLTNIYGSMLFLTCISVDRFLAIVYPFRSRTIRTRRNSAIVCAGVWILVLSGGISASLFSTTNVNNATTTCFEGFSKRVWKTYLSKITIFIEVVGFIIPLILNVSCSSVVLRTLRKPATLSQIGTNKKKVLKMITVHMAVFVVCFVPYNSVLFLYALVRSQAITNCFLERFAKIMYPITLCLATLNCCFDPFIYYFTLESFQKSFYINAHIRMESLFKTETPLTTKPSLPAIQEEVSDQTTNNGGELMLESTF

SEQ ID NO: 52138 - protein, 370 aa, Homo sapiens; identical to SEQ ID NO: 52137

SEQ ID NO: 52139 - protein, 372 aa, Homo sapiens [sequence omitted]

SEQ ID NO: 52140 - protein, 372 aa, Homo sapiens [sequence omitted]

SEQ ID NO: 52141 - protein, 429 aa, Homo sapiens
MLANSSSTNSSVLPCPDYRPTHRLHLVVYSLVLAAGLPLNALALWVFLRALRVHSVVSVYMCNLAASDLLFTLSLPVRLSYYALHHWPFPDLLCQTTGAIFQMNMYGSCIFLMLINVDRYAAIVHPLRLRHLRRPRVARLLCLGVWALILVFAVPAARVHRPSRCRYRDLEVRLCFESFSDELWKGRLLPLVLLAEALGFLLPLAAVVYSSGRVFWTLARPDATQSQRRRKTVRLLLANLVIFLLCFVPYNSTLAVYGLLRSKLVAASVPARDRVRGVLMVMVLLAGANCVLDPLVYYFSAEGFRNTLRGLGTPHRARTSATNGTRAALAQSERSAVTTDATRPDAASQGLLRPSDSHSLSSFTHAIALSVPDSQRLSFWEAYRVYTQEGGLGTWTFGWQFQLSNAEEYKVWKPGPREGSAAGNGFFKL

SEQ ID NO: 52142 - protein, 534 aa, Homo sapiens
MRLRGCGPRAAPASSAGASDARLLAPPGRNPFVHELRLSALQKAQVALMTLTLFPVRLLVAAAMMLLAWPLALVASLGSAEKEPEQPPALWRKVVDFLLKAIMRTMWFAGGFHRVAVKGRQALPTEAAILTLAPHSSYFDAIPVTMTMSSIVMKAESRDIPIWGTLIQYIRPVFVSRSDQDSRRKTVEEIKRRAQSNGKWPQIMIFPEGTCTNRTCLITFKPGAFIPGAPVQPVVLRYPNKLDTITWTWQGPGALEILWLTLCQFHNQVEIEFLPVYSPSEEEKRNPALYASNVRRVMAEALGVSVTDYTFEDCQLALAEGQLRLPADTCLLEFARLVRGLGLKPEKLEKDLDRYSERARMKGGEKIGIAEFAASLEVPVSDLLEDMFSLFDESGSGEVDLRECVVALSVVCRPARTLDTIQLAFKMYGAQEDGSVGEGDLSCILKTALGVAELTVTDLFRAIDQEEKGKITFADFHRFAEMYPAFAEEYLYPDQTHFESCAETSPAPIPNGFCADFSPENSDAGRKPVRKKLD

SEQ ID NO: 52143 - protein, 534 aa, Homo sapiens; identical to SEQ ID NO: 52142

SEQ ID NO: 52144 - protein, 487 aa, Homo sapiens
MASSAEGDEGTVVALAGVLQSGFQELSLNKLATSLGASEQALRLIISIFLGYPFALFYRHYLFYKETYLIHLFHTFTGLSIAYFNFGNQLYHSLLCIVLQFLILRLMGRTITAVLTTFCFQMAYLLAGYYYTATGNYDIKWTMPHCVLTLKLIGLAVDYFDGGKDQNSLSSEQQKYAIRGVPSLLEVAGFSYFYGAFLVGPQFSMNHYMKLVQGELIDIPGKIPNSIIPALKRLSLGLFYLVGYTLLSPHITEDYLLTEDYDNHPFWFRCMYMLIWGKFVLYKYVTCWLVTEGVCILTGLGFNGFEEKGKAKWDACANMKVWLFETNPRFTGTIASFNINTNAWVARYIFKRLKFLGNKELSQGLSLLFLALWHGLHSGYLVCFQMEFLIVIVERQAARLIQESPTLSKLAAITVLQPFYYLVQQTIHWLFMGYSMTAFCLFTWDKWLKVYKSIYFLGHIFFLSLLFILPYIHKAMVPRKEKLKKME

SEQ ID NO: 52145 - protein, 524 aa, Homo sapiens
MSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWLTASQPCSIVDVEFLPVYHPSPEESRDPTLYANNVQRVMAQALGIPATECEFVGSLPVIVVGRLKVALEPQLWELGKVLRKAGLSAGYVDAGAEPGRSRMISQEEFARQLQLSDPQTVAGAFGYFQQDTKGLVDFRDVALALAALDGGRSLEELTRLAFELFAEEQAEGPNRLLYKDGFSTILHLLLGSPHPAATALHAELCQAGSSQGLSLCQFQNFSLHDPLYGKLFSTYLRPPHTSRGTSQTPNASSPGNPTALANGTVQAPKQKGD

SEQ ID NO: 52146 - protein, 230 aa, Homo sapiens
MCGNNMSTPLPAIVPAARKATAAVIFLHGLGDTGHGWAEAFAGIRSSHIKYICPHAPVRPVTLNMNVAMPSWFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 52147 - protein, 214 aa, Homo sapiens
MCGNNMSTPLPAIVPAARKATAAVIFLHGLGDTGHGWAEAFAGIRSSHIKYICPHAFDIIGLSPDSQEDESGIKQAAENIKALIDQEVKNGIPSNRIILGGFSQGGALSLYTALTTQQKLAGVTALSCWLPLRASFPQGPIGGANRDISILQCHGDCDPLVPLMFGSLTVEKLKTLVNPANVTFKTYEGMMHSSCQQEMMDVKQFIDKLLPPID

SEQ ID NO: 52148 - protein, 363 aa, Homo sapiens
MELHERPDERRKARTSTQGRLGDWRRVHADGFTHRVWSSSSWLEPAMTSRTRVTWPSPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 52149 - protein, 317 aa, Homo sapiens
MTSRTRVTWPSPPRPLPVPAAAAVAFGAKGTDPAEARSSRGIEEAGPRAHGRAGREPERRRSRQQRRGGLQARRSTLLKTCARARATAPGAMKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 52150 - protein, 226 aa, Homo sapiens
MKMVAPWTRFYSNSCCLCCHVRTGTILLGVWYLIINAVVLLILLSALADPDQYNFSSSELGGDFEFMDDANMCIAIAISLLMILICAMATYGAYKQRAAWIIPFFCYQIFDFALNMLVAITVLIYPNSIQEYIRQLPPNFPYRDDVMSVNPTCLVLIILLFISIILTFKGYLISCVWNCYRYINGRNSSDVLVYVTSNDTTVLLPPYDDATVNGAAKEPPPPYVSA

SEQ ID NO: 52151 - protein, 262 aa, Homo sapiens
MDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSLPSKTPEGGPAPPPYSEV

SEQ ID NO: 52152 - protein, 290 aa, Homo sapiens
MDPRLSTVRQTCCCFNVRIATTALAIYHVIMSVLLFIEHSVEVAHGKASCKLSQMGYLRIADLISSFLLITMLFIISLSLLIGVVKNREKYLLPFLSLQIMDYLLCLLTLLGSYIELPAYLKLASRSRASSSKFPLMTLQLLDFCLSILTLCSSYMEVPTYLNFKSMNHMNYLPSQEDMPHNQFIKMMIIFSIAFITVLIFKVYMFKCVWRCYRLIKCMNSVEEKRNSKMLQKVVLPSYEEALSPAGPVSCSQLGQRFRLSHSSGLSIIQPNNAWFISISSDTCLDDWPF

SEQ ID NO: 52153 - protein, 3801 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTKILLLGILKIIESDTTMSPSQYLTFPLLHAPNLSNGVSSQKYPGILNSKAMGLLRRARVSRSKKEADRESFPHRLLSSWHIAPVHLPLLGQNCWPHLSEGFSVSLWFNVECIHEAESTTEKGKKIKKRNKSLILPDSSFDGTESDRPEGAEYINPGERLIEEGCIHIISLGSKALMIQVWADPHNATLIFRVCMDSNDDMKAVLLAQVESQENIFLPSKWQHLVLTYLQQPQGKRRIHGKISIWVSGQRKPDVTLDFMLPRKTSLSSDSNKTFCMIGHCLSSQEEFLQLAGKWDLGNLLLFNGAKVGSQEAFYLYACGPNHTSVMPCKYGKPVNDYSKYINKEILRCEQIRELFMTKKDVDIGLLIESLSVVYTTYCPAQYTIYEPVIRLKGQMKTQLSQRPFSSKEVQSILLEPHHLKNLQPTEYKTIQGILHEIGGTGIFVFLFARVVELSSCEETQALALRVILSLIKYNQQRVHELENCNGLSMIHQVLIKQKCIVGFYILKTLLEGCCGEDIIYMNENGEFKLDVDSNAIIQDVKLLEELLLDWKIWSKAEQGVWETLLAALEVLIRADHHQQMFNIKQLLKAQVVHHFLLTCQVLQEYKEGQLTPMPREVCRSFVKIIAEVLGSPPDLELLTIIFNFLLAVHPPTNTYVCHNPTNFYFSLHIDGKIFQEKVRSIMYLRHSSSGGRSLMSPGFMVISPSGFTASPYEGENSSNIIPQQMAAHMLRSRSLPAFPTSSLLTQSQKLTGSLGCSIDRLQNIADTYVATQSKKQNSLGSSDTLKKGKEDAFISSCESAKTVCEMEAVLSAQVSVSDVPKGVLGFPVVKADHKQLGAEPRSEDDSPGDESCPRRPDYLKGLASFQRSHSTIASLGLAFPSQNGSAAVGRWPSLVDRNTDDWENFAYSLGYEPNYNRTASAHSVTEDCLVPICCGLYELLSGVLLILPDVLLEDVMDKLIQADTLLVLVNHPSPAIQQGVIKLLDAYFARASKEQKDKFLKNRGFSLLANQLYLHRGTQELLECFIEMFFGRHIGLDEEFDLEDVRNMGLFQKWSVIPILGLIETSLYDNILLHNALLLLLQILNSCSKVADMLLDNGLLYVLCNTVAALNGLEKNIPMSEYKLLACDIQQLFIAVTIHACSSSGSQYFRVIEDLIVMLGYLQNSKNKRTQNMAVALQLRVLQAAMEFIRTTANHDSENLTDSLQSPSAPHHAVVQKRKSIAGPRKFPLAQTESLLMKMRSVANDELHVMMQRRMSQENPSQATETELAQRLQRLTVLAVNRIIYQEFNSDIIDILRTPENVTQSKTSVFQTEISEENIHHEQSSVFNPFQKEIFTYLVEGFKVSIGSSKASGSKQQWTKILWSCKETFRMQLGRLLVHILSPAHAAQERKQIFEIVHEPNHQEILRDCLSPSLQHGAKLVLYLSELIHNHQGELTEEELGTAELLMNALKLCGHKCIPPSASTKADLIKMIKEEQKKYETEEGVNKAAWQKTVNNNQQSLFQRLDSKSKDISKIAADITQAVSLSQGNERKKVIQHIRGMYKVDLSASRHWQELIQQLTHDRAVWYDPIYYPTSWQLDPTEGPNRERRRLQRCYLTIPNKYLLRDRQKSEDVVKPPLSYLFEDKTHSSFSSTVKDKAASESIRVNRRCISVAPSRETAGELLLGKCGMYFVEDNASDTVESSSLQGELEPASFSWTYEEIKEVHKRWWQLRDNAVEIFLTNGRTLLLAFDNTKVRDDVYHNILTNNLPNLLEYGNITALTNLWYTGQITNFEYLTHLNKHAGRSFNDLMQYPVFPFILADYVSETLDLNDLLIYRNLSKPIAVQYKEKEDRYVDTYKYLEEEYRKGAREDDPMPPVQPYHYGSHYSNSGTVLHFLVRMPPFTKMFLAYQDQSFDIPDRTFHSTNTTWRLSSFESMTDVKELIPEFFYLPEFLVNREGFDFGVRQNGERVNHVNLPPWARNDPRLFILIHRQALESDYVSQNICQWIDLVFGYKQKGKASVQAINVFHPATYFGMDVSAVEDPVQRRALETMIKTYGQTPRQLFHMAHVSRPGAKLNIEGELPAAVGLLVQFAFRETREQVKEITYPSPLSWIKGLKWGEYVGSPSAPVPVVCFSQPHGERFGSLQALPTRAICGLSRNFCLLMTYSKEQGVRSMNSTDIQWSAILSWGYADNILRLKSKQSEPPVNFIQSSQQYQVTSCAWVPDSCQLFTGSKCGVITAYTNRFTSSTPSEIEMETQIHLYGHTEEITSLFVCKPYSILISVSRDGTCIIWDLNRLCYVQSLAGHKSPVTAVSASETSGDIATVCDSAGGGSDLRLWTVNGDLVGHVHCREIICSVAFSNQPEGVSINVIAGGLENGIVRLWSTWDLKPVREITFPKSNKPIISLTFSCDGHHLYTANSDGTVIAWCRKDQQRLKQPMFYSFLSSYAAG

SEQ ID NO: 52154 - protein, 3801 aa, Homo sapiens; identical to SEQ ID NO: 52153

SEQ ID NO: 52155 - protein, 1382 aa, Homo sapiens
MSTDSNSLAREFLTDVNRLCNAVVQRVEAREEEEEETHMATLGQYLVHGRGFLLLTKLNSIIDQALTCREELLTLLLSLLPLVWKIPVQEEKATDFNLPLSADIILTKEKNSSSQRSTQEKLHLEGSALSSQVSAKVNVFRKSRRQRKITHRYSVRDARKTQLSTSDSEANSDEKGIAMNKHRRPHLLHHFLTSFPKQDHPKAKLDRLATKEQTPPDAMALENSREIIPRQGSNTDILSEPAALSVISNMNNSPFDLCHVLLSLLEKVCKFDVTLNHNSPLAASVVPTLTEFLAGFGDCCSLSDNLESRVVSAGWTEEPVALIQRMLFRTVLHLLSVDVSTAEMMPENLRKNLTELLRAALKIRICLEKQPDPFAPRQKKTLQEVQEDFVFSKYRHRALLLPELLEGVLQILICCLQSAASNPFYFSQAMDLVQEFIQHHGFNLFETAVLQMEWLVLRDGVPPEASEHLKALINSVMKIMSTVKKVKSEQLHHSMCTRKRHRRCEYSHFMHHHRDLSGLLVSAFKNQVSKNPFEETADGDVYYPERCCCIAVCAHQCLRLLQQASLSSTCVQILSGVHNIGICCCMDPKSVIIPLLHAFKLPALKNFQQHILNILNKLILDQLGGAEISPKIKKAACNICTVDSDQLAQLEETLQGNLCDAELSSSLSSPSYRFQGILPSSGSEDLLWKWDALKAYQNFVFEEDRLHSIQIANHICNLIQKGNIVVQWKLYNYIFNPVLQRGVELAHHCQHLSVTSAQSHVCSHHNQCLPQDVLQIYVKTLPILLKSRVIRDLFLSCNGVSQIIELNCLNGIRSHSLKAFETLIISLGEQQKDASVPDIDGIDIEQKELSSVHVGTSFHHQQAYSDSPQSLSKFYAGLKEAYPKRRKTVNQDVHINTINLFLCVAFLCVSKEAESDRESANDSEDTSGYDSTASEPLSHMLPCISLESLVLPSPEHMHQAADIWSMCRWIYMLSSVFQKQFYRLGGFRVCHKLIFMIIQKLFRSHKEEQGKKEGDTSVNENQDLNRISQPKRTMKEDLLSLAIKSDPIPSELGSLKKSADSLGKLELQHISSINVEEVSATEAAPEEAKLFTSQESETSLQSIRLLEALLAICLHGARTSQQKMELELPNQNLSVESILFEMRDHLSQSKVIETQLAKPLFDALLRVALGNYSADFEHNDAMTEKSHQSAEELSSQPGDFSEEAEDSQCCSFKLLVEEEGYEADSESNPEDGETQDDGVDLKSETEGFSASSSPNDLLENLTQGEIIYPEICMLELNLLSASKAKLDVLAHVFESFLKIIRQKEKNVFLLMQQGTVKNLLGGFLSILTQDDSDFQACQRVLVDLLVSLMSSRTCSEELTLLLRIFLEKSPCTRATDQKVQST

SEQ ID NO: 52156 - protein, 417 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 52157 - protein, 364 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKETRCEQDRPSPTTAPPAPPSPSPSPVPKSPSVDKYNVSGTNGTCLLASMGLQLNLTYERKDNTTVTRLLNINPNKTSASGSCGAHLVTLELHSEGTTVLLFQFGMNASSSRFFLQGIQLNTILPDARDPAFKAANGSLRALQATVGNSYKCNAEEHVRVTKAFSVNIFKVWVQAFKVEGGQFGSVEECLLDENSMLIPIAVGGALAGLVLIVLIAYLVGRKRSHAGYQTI

SEQ ID NO: 52158 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQDCSADDDNFLVPIAVGAALAGVLILVLLAYFIGLKHHHAGYEQF

SEQ ID NO: 52159 - protein, 410 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 52160 - protein, 411 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAEECSADSDLNFLIPVAVGVALGFLIIVVFISYMIGRRKSRTGYQSV

SEQ ID NO: 52161 - protein, 300 aa, Homo sapiens
MVCFRLFPVPGSGLVLVCLVLGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAEECSADSDLNFLIPVAVGVALGFLIIVVFISYMIGRRKSRTGYQSV

SEQ ID NO: 52162 - protein, 363 aa, Homo sapiens
MNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININPNTTHSTGSCRSHTALLRLNSSTIKYLDFVFAVKNENRFYLKEVNISMYLVNGSVFSIANNNLSYWDAPLGSSYMCNKEQTVSVSGAFQINTFDLRVQPFNVTQGKYSTAQECSLDDDTILIPIIVGAGLSGLIIVIVIAYVIGRRKSYAGYQTL

SEQ ID NO: 52163 - protein, 148 aa, Homo sapiens
MKALIVLGLVLLSVTVQGKVFERCELARTLKRLGMDGYRGISLANWMCLAKWESGYNTRATNYNAGDRSTDYGIFQINSRYWCNDGKTPGAVNACHLSCSALLQDNIADAVACAKRVVRDPQGIRAWVAWRNRCQNRDVRQYVQGCGV

SEQ ID NO: 52164 - protein, 194 aa, Homo sapiens
MQDAPLSCLSPTKWSSVSSADSTEKSASAAGTRNLPFQFCLRQALRMKAAGILTLIGCLVTGAESKIYTRCKLAKIFSRAGLDNYWGFSLGNWICMAYYESGYNTTAQTVLDDGSIDYGIFQINSFAWCRRGKLKENNHCHVACSALVTDDLTDAIICAKKIVKETQGMNYWQGWKKHCEGRDLSDWKKDCEVS

SEQ ID NO: 52165 - protein, 146 aa, Homo sapiens
MKASVVLSLLGYLVVPSGAYILGRCTVAKKLHDGGLDYFEGYSLENWVCLAYFESKFNPMAIYENTREGYTGFGLFQMRGSDWCGDHGRNRCHMSCSALLNPNLEKTIKCAKTIVKGKEGMGAWPTWSRYCQYSDTLARWLDGCKL

SEQ ID NO: 52166 - protein, 146 aa, Homo sapiens; identical to SEQ ID NO: 52165

SEQ ID NO: 52167 - protein, 148 aa, Homo sapiens
MTKALLIYLVSSFLALNQASLISRCDLAQVLQLEDLDGFEGYSLSDWLCLAFVESKFNISKINENADGSFDYGLFQINSHYWCNDYKSYSENLCHVDCQDLLNPNLLAGIHCAKRIVSGARGMNNWVEWRLHCSGRPLFYWLTGCRLR

SEQ ID NO: 52168 - protein, 148 aa, Homo sapiens; identical to SEQ ID NO: 52167

SEQ ID NO: 52169 - protein, 148 aa, Homo sapiens; identical to SEQ ID NO: 52167

SEQ ID NO: 52170 - protein, 417 aa, Homo sapiens
MRFAWTVLLLGPLQLCALVHCAPPAAGQQQPPREPPAAPGAWRQQIQWENNGQVFSLLSLGSQYQPQRRRDPGAAVPGAANASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 52171 - protein, 40 aa, Homo sapiens
MRFAWTVLLLGPLQLCALVHCAPPAAGQQQPPREPPAAPG

SEQ ID NO: 52172 - protein, 377 aa, Homo sapiens
MRFAWTVLLLGPLQLCALVHCAPPAAGQQQPPREPPAAPGAASAQQPRTPILLIRDNRTAAARTRTAGSSGVTAGRPRPTARHWFQAGYSTSRAREAGASRAENQTAPGEVPALSNLRPPSRVDGMVGDDPYNPYKYSDDNPYYNYYDTYERPRPGGRYRPGYGTGYFQYGLPDLVADPYYIQASTYVQKMSMYNLRCAAEENCLASTAYRADVRDYDHRVLLRFPQRVKNQGTSDFLPSRPRYSWEWHSCHQHYHSMDEFSHYDLLDANTQRRVAEGHKASFCLEDTSCDYGYHRRFACTAHTQGLSPGCYDTYGADIDCQWIDITDVKPGNYILKVSVNPSYLVPESDYTNNVVRCDIRYTGHHAYASGCTISPY

SEQ ID NO: 52173 - protein, 774 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHTEDVGVVCSDKRIPGFKFDNSLINQIENLNIQVEDIRIRAILSTYRKRTPVMEGYVEVKEGKTWKQICDKHWTAKNSRVVCGMFGFPGERTYNTKVYKMFASRRKQRYWPFSMDCTGTEAHISSCKLGPQVSLDPMKNVTCENGLPAVVSCVPGQVFSPDGPSRFRKAYKPEQPLVRLRGGAYIGEGRVEVLKNGEWGTVCDDKWDLVSASVVCRELGFGSAKEAVTGSRLGQGIGPIHLNEIQCTGNEKSIIDCKFNAESQGCNHEEDAGVRCNTPAMGLQKKLRLNGGRNPYEGRVEVLVERNGSLVWGMVCGQNWGIVEAMVVCRQLGLGFASNAFQETWYWHGDVNSNKVVMSGVKCSGTELSLAHCRHDGEDVACPQGGVQYGAGVACSETAPDLVLNAEMVQQTTYLEDRPMFMLQCAMEENCLSASAAQTDPTTGYRRLLRFSSQIHNNGQSDFRPKNGRHAWIWHDCHRHYHSMEVFTHYDLLNLNGTKVAEGHKASFCLEDTECEGDIQKNYECANFGDQGITMGCWDMYRHDIDCQWVDITDVPPGDYLFQVVINPNFEVAESDYSNNIMKCRSRYDGHRIWMYNCHIGGSFSEETEKKFEHFSGLLNNQLSPQ

SEQ ID NO: 52174 - protein, 151 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACTSNGWGVTDCKHT

SEQ ID NO: 52175 - protein, 96 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVV

SEQ ID NO: 52176 - protein, 139 aa, Homo sapiens
MERPLCSHLCSCLAMLALLSPLSLAQYDSWPHYPEYFQQPAPEYHQPQAPANVAKIQLRLAGQKRKHSEGRVEVYYDGQWGTVCDDDFSIHAAHVVCRELGYVEAKSWTASSSYGKGEGPIWLDNLHCTGNEATLAACT

SEQ ID NO: 52177 - protein, 753 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 52178 - protein, 608 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRIRLSGGRSQHEGRVEVQIGGPGPLRWGLICGDDWGTLEAMVACRQLGLGYANHGLQETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 52179 - protein, 697 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQGEARVRLKGGAHPGEGRVEVLKASTWGTVCDRKWDLHAASVVCRELGFGSAREALSGARMGQGMGAIHLSEVRCSGQELSLWKCPHKNITAEDCSHSQDAGVRCNLPYTGAETRETWYWDSGNITEVVMSGVRCTGTELSLDQCAHHGTHITCKRTGTRFTAGVICSETASDLLLHSALVQETAYIEDRPLHMLYCAAEENCLASSARSANWPYGHRRLLRFSSQIHNLGRADFRPKAGRHSWVWHECHGHYHSMDIFTHYDILTPNGTKVAEGHKASFCLEDTECQEDVSKRYECANFGEQGITVGCWDLYRHDIDCQWIDITDVKPGNYILQVVINPNFEVAESDFTNNAMKCNCKYDGHRIWVHNCHIGDAFSEEANRRFERYPGQTSNQII

SEQ ID NO: 52180 - protein, 303 aa, Homo sapiens
MRPVSVWQWSPWGLLLCLLCSSCLGSPSPSTGPEKKAGSQGLRFRLAGFPRKPYEGRVEIQRAGEWGTICDDDFTLQAAHILCRELGFTEATGWTHSAKYGPGTGRIWLDNLSCSGTEQSVTECASRGWGNSDCTHDEDAGVICKDQRLPGFSDSNVIEVEHHLQVEEVRIRPAVGWGRRPLPVTEGLVEVRLPDGWSQVCDKGWSAHNSHVVCGMLGFPSEKRVNAAFYRLLAQRQQHSFGLHGVACVGTEAHLSLCSLEFYRANDTARCPGGGPAVVSCVPGPVYAASSGQKKQQQSKPQG

SEQ ID NO: 52181 - protein, 756 aa, Homo sapiens
MAWSPPATLFLFLLLLGQPPPSRPQSLGTTKLRLVGPESKPEEGRLEVLHQGQWGTVCDDNFAIQEATVACRQLGFEAALTWAHSAKYGQGEGPIWLDNVRCVGTESSLDQCGSNGWGVSDCSHSEDVGVICHPRRHRGYLSETVSNALGPQGRRLEEVRLKPILASAKQHSPVTEGAVEVKYEGHWRQVCDQGWTMNNSRVVCGMLGFPSEVPVDSHYYRKVWDLKMRDPKSRLKSLTNKNSFWIHQVTCLGTEPHMANCQVQVAPARGKLRPACPGGMHAVVSCVAGPHFRPPKTKPQRKGSWAEEPRVRLRSGAQVGEGRVEVLMNRQWGTVCDHRWNLISASVVCRQLGFGSAREALFGARLGQGLGPIHLSEVRCRGYERTLSDCPALEGSQNGCQHENDAAVRCNVPNMGFQNQVRLAGGRIPEEGLLEVQVEVNGVPRWGSVCSENWGLTEAMVACRQLGLGFAIHAYKETWFWSGTPRAQEVVMSGVRCSGTELALQQCQRHGPVHCSHGGGRFLAGVSCMDSAPDLVMNAQLVQETAYLEDRPLSQLYCAHEENCLSKSADHMDWPYGYRRLLRFSTQIYNLGRTDFRPKTGRDSWVWHQCHRHYHSIEVFTHYDLLTLNGSKVAEGHKASFCLEDTNCPTGLQRRYACANFGEQGVTVGCWDTYRHDIDCQWVDITDVGPGNYIFQVIVNPHYEVAESDFSNNMLQCRCKYDGHRVWLHNCHTGNSYPANAELSLEQEQRLRNNLI

SEQ ID NO: 52182 - protein, 597 aa, Homo sapiens
MAAVQAAEVKVDGSEPKLSKNELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 52183 - protein, 625 aa, Homo sapiens
MLTQAAVRLVRGSLRKTSWAEWGHRELRLGQLAPFTAPHKDKSFSDQRSELKRRLKAEKKVAEKEAKQKELSEKQLSQATAAATNHTTDNGVGPEEESVDPNQYYKIRSQAIHQLKVNGEDPYPHKFHVDISLTDFIQKYSHLQPGDHLTDITLKVAGRIHAKRASGGKLIFYDLRGEGVKLQVMANSRNYKSEEEFIHINNKLRRGDIIGVQGNPGKTKKGELSIIPYEITLLSPCLHMLPHLHFGLKDKETRYRQRYLDLILNDFVRQKFIIRSKIITYIRSFLDELGFLEIETPMMNIIPGGAVAKPFITYHNELDMNLYMRIAPELYHKMLVVGGIDRVYEIGRQFRNEGIDLTHNPEFTTCEFYMAYADYHDLMEITEKMVSGMVKHITGSYKVTYHPDGPEGQAYDVDFTPPFRRINMVEELEKALGMKLPETNLFETEETRKILDDICVAKAVECPPPRTTARLLDKLVGEFLEVTCINPTFICDHPQIMSPLAKWHRSKEGLTERFELFVMKKEICNAYTELNDPMRQRQLFEEQAKAKAAGDDEAMFIDENFCTALEYGLPPTAGWGMGIDRVAMFLTDSNNIKEVLLFPAMKPEDKKENVATTDTLESTTVGTSV

SEQ ID NO: 52184 - protein, 522 aa, Homo sapiens
MQPWHGKAMQRASEAGATAPKASARNARGAPMDPTESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHVCTQNPQDSQWDRKDLGLCFDNCVTYFLQCLRTEKLENYFIPEFNLFSSNLIDKRSKEFLTKQIEYERNNEFPVFDEF

SEQ ID NO: 52185 - protein, 447 aa, Homo sapiens
MQPWHGKAMQRASEAGATAPKASARNARGAPMDPTESPAAPEAALPKAGKFGPARKSGSRQKKSAPDTQERPPVRATGARAKKAPQRAQDTQPSDATSAPGAEGLEPPAAREPALSRAGSCRQRGARCSTKPRPPPGPWDVPSPGLPVSAPILVRRDAAPGASKLRAVLEKLKLSRDDISTAAGMVKGVVDHLLLRLKCDSAFRGVGLLNTGSYYEHVKISAPNEFDVMFKLEVPRIQLEEYSNTRAYYFVKFKRNPKENPLSQFLEGEILSASKMLSKFRKIIKEEINDIKDTDVIMKRKRGGSPAVTLLISEKISVDITLALESKSSWPASTQEGLRIQNWLSAKVRKQLRLKPFYLVPKHAKEGNGFQEETWRLSFSHIEKEILNNHGKSKTCCENKEEKCCRKDCLKLMKYLLEQLKERFKDKKHLDKFSSYHVKTAFFHRLY

SEQ ID NO: 52186 - protein, 359 aa, Homo sapiens
MIAAQAKLVYHLNKYYNEKCQARKAAIAKTIREVCKVVSDVLKEVEVQEPRFISSLNEMDNRYEGLEVISPTEFEVVLYLNQMGVFNFVDDGSLPGCAVLKLSDGRKRSMSLWVEFITASGYLSARKIRSRFQTLVAQAVDKCSYRDVVKMVADTSEVKLRIRDRYVVQITPAFKCTGIWPRSAAHWPLPHIPWPGPNRVAEVKAEGFNLLSKECHSLAGKQSSAESDAWVLQFAEAENRLQMGGCRKKCLSILKTLRDRHLELPGQPLNNYHMKTLVSYECEKHPRESDWDESCLGDRLNGILLQLISCLQCRRCPHYFLPNLDLFQGKPHSALENAAKQTWRLAREILTNPKSLEKL

SEQ ID NO: 52187 - protein, 425 aa, Homo sapiens
MYPSNKKKKVWREEKERLLKMTLEERRKEYLRDYIPLNSILSWKEEMKGKGQNDEENTQETSQVKKSLTEKVSLYRGDITLLEVDAIVNAANASLLGGGGVDGCIHRAAGPCLLAECRNLNGCDTGHAKITCGYDLPAKYVIHTVGPIARGHINGSHKEDLANCYKSSLKLVKENNIRSVAFPCISTGIYGFPNEPAAVIALNTIKEWLAKNHHEVDRIIFCVFLEVDFKIYKKKMNEFFSVDDNNEEEEDVEMKEDSDENGPEEKQSVEEMEEQSQDADGVNTVTVPGPASEEAVEDCKDEDFAKDENITKGGEVTDHSVRDQDHPDGQENDSTKNEIKIETESQSSYMETEELSSNQEDAVIVEQPEVIPLTEDQEEKEGEKAPGEDTPRMPGKSEGSSDLENTPGPDAGAQDEAKEQRNGTK

SEQ ID NO: 52188 - protein, 448 aa, Homo sapiens
MYPSNKKKKVWREEKERLLKMTLEERRKEYLRDYIPLNSILSWKEEMKGKGQNDEENTQETSQVKKSLTEKVSLYRGDITLLEVDAIVNAANASLLGGGGVDGCIHRAAGPCLLAECRNLNGCDTGHAKITCGYDLPAKYVIHTVGPIARGHINGSHKEDLANCYKSSLKLVKENNIRSVAFPCISTGIYGFPNEPAAVIALNTIKEWLAKNHHEVDRIIFCVFLEVDFKIYKKKMNEFFSVDDNNEEEEDVEMKEDSDENGPEEKQSVEEMEEQSQDADGVNTVTVPGPASEEAVEDCKDEDFAKDENITKGGEVTDHSVRDQDHPDGQENDSTKNEIKIETESQSSYMETEELSSNQEDAVIVEQPEVIPLTEDQEEKEGEKAPGEDTPRMPGKSEGSSDLENTPGPDVEMNSQVDKVNDPTESQQEDQLIAGAQDEAKEQRNGTK

SEQ ID NO: 52189 - protein, 213 aa, Homo sapiens
MNEFFSVDDNNEEEEDVEMKEDSDENGPEEKQSVEEMEEQSQDADGVNTVTVPGPASEEAVEDCKDEDFAKDENITKGGEVTDHSVRDQDHPDGQENDSTKNEIKIETESQSSYMETEELSSNQEDAVIVEQPEVIPLTEDQEEKEGEKAPGEDTPRMPGKSEGSSDLENTPGPDVEMNSQVDKVNDPTESQQEDQLIAGAQDEAKEQRNGTK

SEQ ID NO: 52190 - protein, 213 aa, Homo sapiens; identical to SEQ ID NO: 52189

SEQ ID NO: 52191 - protein, 355 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIESCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52192 - protein, 396 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52193 - protein, 328 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIETCKKALQPSRREPAGRGAPGHGHAGLPARHAHLPVQGPSGPCTVADADPAVPVRQLPTTPAGKQFCVHPHPAGWPLSHQEQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52194 - protein, 317 aa, Homo sapiens
MTLKVQEYPTLKVPYETLNKRFRAAQKNIDRETSHVTMVVAELEKTLSGCPAVDSVVSLLDGVVEKLSVLKRKDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52195 - protein, 434 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKGRQNKHEAKTGRKSRAASSSPKESLDLGMETLKGKPELSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52196 - protein, 348 aa, Homo sapiens
MVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52197 - protein, 395 aa, Homo sapiens
MWTLRATGREVGSSSCEDTVAPVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52198 - protein, 328 aa, Homo sapiens
MAVQESAAQLSMTLKVQEYPTLKVPYETLNKRFRAAQKNIDRETSHVTMVVAELEKTLSGCPAVDSVVSLLDGVVEKLSVLKRKAVESIQAEDESAKLCKRRIEHLKEHSSDQPAAASVWKRKRMDRMMVEHLLRCGYYNTAVKLARQSGIETCKKALQPSRREPAGRGAPGHGHAGLPARHAHLPVQGPSGPCTVADADPAVPVRQLPTTPAGKQFCVHPHPAGWPLSHQDTCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52199 - protein, 375 aa, Homo sapiens
MAVQESAAQLSMTLKVQEYPTLKVPYETLNKRFRAAQKNIDRETSHVTMVVAELEKLSVLKRKAVESIQAEDESAKLCKRRIEHLKEHSSDQPAAASVWKRKRMDRMMVEHLLRCGYYNTAVKLARQSGIEDLVNIEMFLTAKEVEESLERRETATCLAWCHDNKSRLRKMKSCLEFSLRIQEFIELIRQNKRLDAVRHARKHFSQAEGSQLDEVRQAMGMLAFPPDTHISPYKDLLDPARWRMLIQQFRYDNYRLHQLGNNSVFTLTLQAGLSAIKTPQCYKEDGSSKSPDCPVCSRSLNKLAQPLPMAHCANSRLVCKISGDVMNENNPPMMLPNGYVYGYNSLLSIRQDDKVVCPRTKEVFHFSQAEKVYIM

SEQ ID NO: 52200 - protein, 115 aa, Homo sapiens
MPMFIVNTNVPRASVPDGFLSELTQQLAQATGKPPQYIAVHVVPDQLMAFGGSSEPCALCSLHSIGKIGGAQNRSYSKLLCGLLAERLRISPDRVYINYYDMNAANVGWNNSTFA

SEQ ID NO: 52201 - protein, 520 aa, Homo sapiens
MRNKKILKEDELLSETQQAAFHQIAMEPFEINVPKPKRRNGVNFSLAVVVIYLILLTAGAGLLVVQVLNLQARLRVLEMYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 52202 - protein, 442 aa, Homo sapiens
MYFLNDTLAAEDSPSFSLLQSAHPGEHLAQGASRLQVLQAQLTWVRVSHEHLLQRVDNFTQNPGMFRIKGEQGAPGLQGHKGAMGMPGAPGPPGPPAEKGAKGAMGRDGATGPSGPQGPPGVKGEAGLQGPQGAPGKQGATGTPGPQGEKGSKGDGGLIGPKGETGTKGEKGDLGLPGSKGDRGMKGDAGVMGPPGAQGSKGDFGRPGPPGLAGFPGAKGDQGQPGLQGVPGPPGAVGHPGAKGEPGSAGSPGRAGLPGSPGSPGATGLKGSKGDTGLQGQQGRKGESGVPGPAGVKGEQGSPGLAGPKGAPGQAGQKGDQGVKGSSGEQGVKGEKGERGENSVSVRIVGSSNRGRAEVYYSGTWGTICDDEWQNSDAIVFCRMLGYSKGRALYKVGAGTGQIWLDNVQCRGTESTLWSCTKNSWGHHDCSHEEDAGVECSV

SEQ ID NO: 52203 - protein, 451 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 52204 - protein, 388 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLSTGPIWLNEVFCFGRESSIEECKIRQWGTRACSHSEDAGVTCTL

SEQ ID NO: 52205 - protein, 388 aa, Homo sapiens; identical to SEQ ID NO: 52204

SEQ ID NO: 52206 - protein, 358 aa, Homo sapiens
MEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLRPVQLTDHIRAGPS

SEQ ID NO: 52207 - protein, 469 aa, Homo sapiens
MCYLSAIISISLLNKKPSMEQWDHFHNQQEDTDSCSESVKFDARSMTALLPPNPKNSPSLQEKLKSFKAALIALYLLVFAVLIPLIGIVAAQLLKWETKNCSVSSTNANDITQSLTGKGNDSEEEMRFQEVFMEHMSNMEKRIQHILDMEANLMDTEHFQNFSMTTDQRFNDILLQLSTLFSSVQGHGNAIDEISKSLISLNTTLLDLQLNIENLNGKIQENTFKQQEEISKLEERVYNVSAEIMAMKEEQVHLEQEIKGEVKVLNNITNDLRLKDWEHSQTLRNITLIQGPPGPPGEKGDRGPTGESGPRGFPGPIGPPGLKGDRGAIGFPGSRGLPGYAGRPGNSGPKGQKGEKGSGNTLTPFTKVRLVGGSGPHEGRVEILHSGQWGTICDDRWEVRVGQVVCRSLGYPGVQAVHKAAHFGQGTGPIWLNEVFCFGRESSIEECKIRQWGTRACSHSEDAGVTCTL

SEQ ID NO: 52208 - protein, 64 aa, Homo sapiens
MEQWDHFHNQQEDTDSCSESVKFDARSMTALLPPNPKNSPSLQEKLKSFKAALIALYLLVFAVL

SEQ ID NO: 52209 - protein, 132 aa, Homo sapiens [sequence omitted]

SEQ ID NO: 52210 - protein, 1400 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEYIGLGAVADCVGINVTVGGESCQHEFRGDMVVCPLPPSLQLGQDGAPLQVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARSMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 52211 - protein, 1351 aa, Homo sapiens
MELLPPLPQSFLLLLLLPAKPAAGEDWQCPRTPYAASRDFDVKYVVPSFSAGGLVQAMVTYEGDRNESAVFVAIRNRLHVLGPDLKSVQSLATGPAGDPGCQTCAACGPGPHGPPGDTDTKVLVLDPALPALVSCGSSLQGRCFLHDLEPQGTAVHLAAPACLFSAHHNRPDDCPDCVASPLGTRVTVVEQGQASYFYVASSLDAAVAASFSPRSVSIRRLKADASGFAPGFVALSVLPKHLVSYSIEYVHSFHTGAFVYFLTVQPASVTDDPSALHTRLARLSATEPELGDYRELVLDCRFAPKRRRRGAPEGGQPYPVLRVAHSAPVGAQLATELSIAEGQEVLFGVFVTGKDGGPGVGPNSVVCAFPIDLLDTLIDEGVERCCESPVHPGLRRGLDFFQSPSFCPNPPGLEALSPNTSCRHFPLLVSSSFSRVDLFNGLLGPVQVTALYVTRLDNVTVAHMGTMDGRILQVELVRSLNYLLYVSNFSLGDSGQPVQRDVSRLGDHLLFASGDQVFQVPIQGPGCRHFLTCGRCLRAWHFMGCGWCGNMCGQQKECPGSWQQDHCPPKLTEFHPHSGPLRGSTRLTLCGSNFYLHPSGLVPEGTHQVTVGQSPCRPLPKDSSKLRPVPRKDFVEEFECELEPLGTQAVGPTNVSLTVTNMPPGKHFRVDGTSVLRGFSFMEPVLIAVQPLFGPRAGGTCLTLEGQSLSVGTSRAVLVNGTECLLARVSEGQLLCATPPGATVASVPLSLQVGGAQVPGSWTFQYREDPVVLSISPNCGYINSHITICGQHLTSAWHLVLSFHDGLRAVESRCERQLPEQQLCRLPEYVVRDPQGWVAGNLSARGDGAAGFTLPGFRFLPPPHPPSANLVPLKPEEHAIKFEVCVDGECHILGRVVRPGPDGVPQSTLLGILLPLLLLVAALATALVFSYWWRRKQLVLPPNLNDLASLDQTAGATPLPILYSGSDYRSGLALPAIDGLDSTTCVHGASFSDSEDESCVPLLRKESIQLRDLDSALLAEVKDVLIPHERVVTHSDRVIGKGHFGVVYHGEYIDQAQNRIQCAIKSLSRITEMQQVEAFLREGLLMRGLNHPNVLALIGIMLPPEGLPHVLLPYMCHGDLLQFIRSPQRNPTVKDLISFGLQVARSMEYLAEQKFVHRDLAARNCMLDESFTVKVADFGLARDILDREYYSVQQHRHARLPVKWMALESLQTYRFTTKSDVWSFGVLLWELLTRGAPPYRHIDPFDLTHFLAQGRRLPQPEYCPDSLYQVMQQCWEADPAVRPTFRVLVGEVEQIVSALLGDHYVQLPATYMNLGPSTSHEMNVRPEQPQFSPMPGNVRRPRPLSEPPRPT

SEQ ID NO: 52212 - protein, 718 aa, Homo sapiens
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 52213 - protein, 718 aa, Homo sapiens; identical to SEQ ID NO: 52212

SEQ ID NO: 52214 - protein, 626 aa, Homo sapiens
MLPARGCVRKRTVWPRLARVLIVTLLTLELSYAPLPCQLSGVPYNTGDPVGRWARPCIWPCPWHTTINALKGRISELQWSVMDQEMRVKRLESEKQELQEQLDLQHKKCQEANQKIQELQASQEARADHEQQIKDLEQKLSLQEQDAAIVKNMKSELVRLPRLERELKQLREESAHLREMRETNGLLQEELEGLQRKLGRQEKMQETLVGLELENERLLAKLQSWERLDQTMGLSIRTPEDLSRFVVELQQRELALKDKNSAVTSSARGLEKARQQLQEELRQVSGQLLEERKKRETHEALARRLQKRVLLLTKERDGMRAILGSYDSELTPAEYSPQLTRRMREAEDMVQKVHSHSAEMEAQLSQALEELGGQKQRADMLEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 52215 - protein, 718 aa, Homo sapiens; identical to SEQ ID NO: 52212

SEQ ID NO: 52216 - protein, 157 aa, Homo sapiens
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGE

SEQ ID NO: 52217 - protein, 269 aa, Homo sapiens
MRELEFAKLECCLAWQLQASRRELEMELKMLKSQSSSAEQSFLFSREEADTLRLKVEELEGERSRLEEEKRMLEAQLERRALQGDYDQSRTKVLHMSLNPTSVARQRLREDHSQLQAECERLRGLLRAMERGGTVPADLEAAAASLPSSKEVAELKKQVESAELKNQRLKEVFQTKIQEFRKACYTLTGYQIDITTENQYRLTSLYAEHPGDCLIFKATSPSGSKMQLLETEFSHTVGELIEVHLRRQDSIPAFLSSLTLELFSRQTVA

SEQ ID NO: 52218 - protein, 205 aa, Homo sapiens
MALQLSREQGITLRGSAEIVAEFFSFGINSILYQRGIYPSETFTRVQKYGLTLLVTTDLELIKYLNNVVEQLKDWLYKCSVQKLVVVISNIESGEVLERWQFDIECDKTAKDDSAPREKSQKAIQDEIRSVIRQITATVTFLPLLEVSCSFDLLIYTDKDLVVPEKWEESGPQFITNSEEVRLRSFTTTIHKVNSMVAYKIPVND

SEQ ID NO: 52219 - protein, 403 aa, Homo sapiens
MPNRKASRNAYYFFVQEKIPELRRRGLPVARVADAIPYCSSDWAKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 52220 - protein, 434 aa, Homo sapiens
MPNRKASRNAYYFFVQEKIPELRRRGLPVARVADAIPYCSSDWALLREEEKEKYAEMAREWRAAQGKDPGPSEKQKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 52221 - protein, 316 aa, Homo sapiens
MPNRKASRNAYYFFVQEKIPELRRRGLPVARVADAIPYCSSDWAKPVFTPLRRPGMLVPKQNVSPPDMSALSLKGDQALLGGIFYFLNIFSHGELPPHCEQRFLPCEIGCVKYSLQEGIMADFHSFINPGEIPRGFRFHCQAASDSSHKIPISNFERGHNQATVLQNLYRFIHPNPGNWPPIYCKSDDRTRVNWCLKHMAKASEIRQDLQLLTVEDLVVGIYQQKFLKEPSKTWIRSLLDVAMWDYSSNTRCKWHEENDILFCALAVCKKIAYCISNSLATLFGIQLTEAHVPLQDYEASNSVTPKMVVLDAGRYQ

SEQ ID NO: 52222 - protein, 156 aa, Homo sapiens
LLQRCKWHEENDILFCALAVCKKIAYCISNSLATLFGIQLTEAHVPLQDYEASNSVTPKMVVLDAGRYQKLRVGSSGFSHFNSSNEEQRSNTPIGDYPSRAKISGQNSSVRGRGITRLLESISNSSSNIHKFSNCDTSLSPYMSQKDGYKSFSSLS

SEQ ID NO: 52223 - protein, 248 aa, Homo sapiens
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 52224 - protein, 248 aa, Homo sapiens; identical to SEQ ID NO: 52223

SEQ ID NO: 52225 - protein, 196 aa, Homo sapiens
MDQRQRRILGQPLSIPTSQPKQKRTSMISFFSKVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDACKTTFQACSPYLKLKEEYSFQSEEDQRNTKLYQQLSHYHPEILQFFYANKIL

SEQ ID NO: 52226 - protein, 210 aa, Homo sapiens
MAWGSKGIQGWENLAESSHLATTRESSPPESGTGSGSSRGSRLQEPQVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDACKTTFQACSPYLKLKEEYSFQSEEDQRNTKLYQQLSHYHPEILQFFYANKIL

SEQ ID NO: 52227 - protein, 262 aa, Homo sapiens
MAWGSKGIQGWENLAESSHLATTRESSPPESGTGSGSSRGSRLQEPQVSWKLRFQKREPLKNVFFILAERARDPSAKKRHMAMRNLGTMAYEAPDKVRKYKKIVLDLLVYGLYDPVNLEVIHESMKTLTVVLGKIQGKGLGSFFIDITLQTRTLLDDENDSLRYSAFVLFGQLAAFAGRKWKKFFTSQVKQTRDSLLIHLQDRNPQVAKACKTTFQACSPYLKLKEEYSFQSEEDQRNTKLYQQLSHYHPEILQFFYANKIL

SEQ ID NO: 52228 - protein, 196 aa, Homo sapiens; identical to SEQ ID NO: 52225

SEQ ID NO: 52229 - protein, 256 aa, Homo sapiens
MKLLENSSFEAINSQLTVETGDAHIIGRIESYSCKMAGDDKHMFKQFCQEGQPHVLEALSPPQTSGLSPSRLSKSQGGEEEGPLSDKCSRKTLFYLIATLNESFRPDYDFSTARSHEFSREPSLSWVVNAVNCSLFSAVREDFKDLKPQLWNAVDEEICLAECDIYSYNPDLDSDPFGEDGSLWSFNYFFYNKRLKRIVFFSCRSISGSTYTPSEAGNELDMELGEEEVEEESRSGGSGAEETSTMEEDRVPVICI

SEQ ID NO: 52230 - protein, 70 aa, Homo sapiens
MKLLENSSFEAINSQLTVETGDAHIIGRIESYSCKMAGDDKHMFKQFCQEGQPHVLEALSPPQTSGLSPS

SEQ ID NO: 52231 - protein, 256 aa, Homo sapiens; identical to SEQ ID NO: 52229

SEQ ID NO: 52232 - protein, 367 aa, Homo sapiens
MRKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 52233 - protein, 218 aa, Homo sapiens
MVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAALCFVLAMTSGQMWNHIRGPPYAHKNPHTGHVNYIHGSSQAQFVAETHIVLLFNGGVTLGMVLLCEAATSDMDIGKRKIMCVAGIGLVVLFFSWMLSIFRSKYHGYPYSFLMS

SEQ ID NO: 52234 - protein, 109 aa, Homo sapiens
MESDFYLRYYVGHKGKFGHEFLEFEFRPDGKLRYANNSNYKNDVMIRKEELEIVIGDEHISFTTSKIGSLIDVNQSKDPEGLRVFYYLVQDLKCLVFSLIGLHFKIKPI

SEQ ID NO: 52235 - protein, 146 aa, Homo sapiens
MESDFYLRYYVGHKGKFGHEFLEFEFRPDGKLRYANNSNYKNDVMIRKEAYVHKSVMEELKRIIDDSEITKEDDALWPPPDRVGRQELEIVIGDEHISFTTSKIGSLIDVNQSKDPEGLRVFYYLVQDLKCLVFSLIGLHFKIKPI

SEQ ID NO: 52236 - protein, 576 aa, Homo sapiens
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPGRPTSMETAHGLATTSPTWPPLGGPSPDPSAAELTPL

SEQ ID NO: 52237 - protein, 552 aa, Homo sapiens
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSCPFKKSKPHPASLASKKPKRETNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDE

SEQ ID NO: 52238 - protein, 531 aa, Homo sapiens
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDAVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLPFRALLQIRAVRKKPGALSPVSFSPVLAQSLEHDEHSNSDSVPPGYEPISLLEALNGLRAVSPAIPSAPLYEEITYSGISDGLSQASCPLAAIDHILDSSRQKGRPQSKAPDSTLRSPSSPIHEEDEEKLSEDVDAPPPLGGAELALRESSSPESFITEEVDESSSPQQGTRAASIENVLQDSSPEHCGRGPPADIYLPALGPDSCSVGIDE

SEQ ID NO: 52239 - protein, 320 aa, Homo sapiens
MGSILSRRIAGVEDIDIQANSAYRYPPKSGNYFASHFFMGGEKFDTPHPEGYLFGENMDLNFLGSRPVQFPYVTPAPHEPVKTLRSLVNIRKDSLRLVRYKDDADSPTEDGDKPRVLYSLEFTFDADARVAITIYCQASEEFLNGRAVYSPKSPSLQSETVHYKRGVSQQFSLPSFKIDFSEWKDDELNFDLDRGVFPVVIQAVVDEGDVVEVTGHAHVLLAAFEKHMDGSFSVKPLKQKQIVDRVSYLLQEIYGIENKNNQETKPSDDENSDNSNECVVCLSDLRDTLILPCRHLCLCTSCADTLRYQANNCPICRLQL

SEQ ID NO: 52240 - protein, 543 aa, Homo sapiens
MAKGEGAESGSAAGLLPTSILQSTERPAQVKKEPKKKKQQLSVCNKLCYALGGAPYQVTGCALGFFLQIYLLDVAQKDEEVVFCFSSFQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 52241 - protein, 530 aa, Homo sapiens
MAKGEGAESGSAAGLLPTSILQSTERPAQVKKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 52242 - protein, 374 aa, Homo sapiens
MVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQREPYEAQQSEPIAYFRGLRLVMSHGPYIKLITGFLFTSLAFMLVEGNFVLFCTYTLGFRNEFQNLLLAIMLSATLTIPIWQWFLTRFGKKTAVYVGISSAVPFLILVALMESNLIITYAVAVAAGISVAAAFLLPWSMLPDVIDDFHLKQPHFHGTEPIFFSFYVFFTKFASGVSLGISTLSLDFAGYQTRGCSQPERVKFTLNMLVTMAPIVLILLGLLLFKMYPIDEERRRQNKKALQALRDEASSSGCSETDSTELASIL

SEQ ID NO: 52243 - protein, 266 aa, Homo sapiens
MAKGEGAESGSAAGLLPTSILQSTERPAQKEPKKKKQQLSVCNKLCYALGGAPYQVTGCALGFFLQIYLLDVAQVGPFSASIILFVGRAWDAITDPLVGLCISKSPWTCLGRLMPWIIFSTPLAVIAYFLIWFVPDFPHGQTYWYLLFYCLFETMVTCFHVPYSALTMFISTEQTERDSATAYRMTVEVLGTVLGTAIQGQIVGQADTPCFQDLNSSTVASQSANHTHGTTSHRETQKAYLLAAGVIVCIYIICAVILILGVREQR

SEQ ID NO: 52244 - protein, 791 aa, Homo sapiens
MADDKVAILTDDEEEQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIEFCSAPFWGVVADRFKKGKIVLLFSLLCWVLFNLGIGFVKPATLRCVPKIRPTTHPTNASHQLTILPTNSSFTSFLTISPKMREKRNLLETRLNVSDTVTLPTAPNMNSEPTLQPQTGEITNRMMDLTLNSSTATPVSPGSVTKETTTVIVTTTKSLPSDQVMLVYDQQEVEAIFLVILVVVIIGEFFSASSVTIVDTVTLQYLGKHRDRYGLQRMWGSLGWGLAMLSVGIGIDYTHIEVLIDGKGCKPPEYRNYQIVFIVFGVLMTMALIVATQFRFRYNHFKNDDSKGKEVEIPQVERNNSTESSEETPTTTSHSQAFNFWDLIKLLCSVQYGSVLFVAWFMGFGYGFVFTFLYWHLEDLNGTTTLFGVCSVLSHVSELTAYFFSHKLIELIGHIRVLYIGLACNTARYIYISYLENAWTVLPMEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 52245 - protein, 791 aa, Homo sapiens; identical to SEQ ID NO: 52244

SEQ ID NO: 52246 - protein, 42 aa, Homo sapiens
MADDKVAILTDDEEEQKRKYVLADPFNGISREPEPPSNETPS

SEQ ID NO: 52247 - protein, 114 aa, Homo sapiens
MADDKVAILTDDEEEQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIE

SEQ ID NO: 52248 - protein, 156 aa, Homo sapiens
MADDKVAILTDDEEEQKRKYVLADPFNGISREPEPPSNETPSSTETSAIPEEEIDWIEKHCVKINNDLLISKVFYFFFYSAYGSLYPLLPVYYKQLGMSPSQSGLLVGIRYFIEFCSAPFWGVVADRFKKGKIVLLFSLLCWVLFNLGIGFVKPAT

SEQ ID NO: 52249 - protein, 253 aa, Homo sapiens
MEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVMPRIEPRLPPKKTKHQEEQEDVNKPAWGVSSSPWVTFVYALYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 52250 - protein, 231 aa, Homo sapiens
MEVLQGVTHAAIWAACISYLSAAVPPELRTSAQGILQGLHLGLGRGCGAMIGGVLVNYFGAAATFRGIGMACLVILLLFALIQWLAVPDEEEDKTMLAERIPVPSSPVPIATIDLVQQQTEDVNKPAWGVSSSPWVTFVYALYQIKEMMQLTRDNRASEIQPLQGTNENRENSPAGRAQPVPCETHSDPSRNQPSPDAAASQTQTSPAHPSVDPCTEESEEQQAQLAAGGH

SEQ ID NO: 52251 - protein, 518 aa, Homo sapiens
MAGLRNESEQEPLLGDTPGSREWDILETEEHYKSRWRSIRILYLTMFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPVFQTCFTFLGEKGVTWDVIKLQINMYTTPVLLSAFLGILNIILILAILREHRVDDSGRQCKSINFEEASTDEAQVPQGNIDQVAVVAINVLFFVTLFIFALFETIITPLTMDMYAWTQEQAVLYNGIILAALGVEAVVIFLGVKLLSKKIGERAILLGGLIVVWVGFFILLPWGNQFPKIQWEDLHNNSIPNTTFGEIIIGLWKSPMEDDNERPTGCSIEQAWCLYTPVIHLAQFLTSAVLIGLGYPVCNLMSYTLYSKILGPKPQGVYMGWLTASGSGARILGPMFISQVYAHWGPRWAFSLVCGIIVLTITLLGVVYKRLIALSVRYGRIQE

SEQ ID NO: 52252 - protein, 153 aa, Homo sapiens
MFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAVFQTCFTFLGEKGVTWDVIKLQINMYTTPVLLSAFLGILNIILILAILSKYR

SEQ ID NO: 52253 - protein, 184 aa, Homo sapiens
MFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPENIVWMTQEDSVKVLILKKQVQMKLRFPKEILTRLLLWPSMFCFL

SEQ ID NO: 52254 - protein, 249 aa, Homo sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTESETIPLVMKAVSGSIVLVIVLAGVGVLVWRRRPREQNGAIYLPTPDR

SEQ ID NO: 52255 - protein, 260 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 52256 - protein, 260 aa, Homo sapiens; identical to SEQ ID NO: 52255

SEQ ID NO: 52257 - protein, 23 aa, Homo sapiens
MRPEDRMFHIRAVILRALSLAFL

SEQ ID NO: 52258 - protein, 128 aa, Homo sapiens
  MOD_RES (1)..(1): Any amino acid
XNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLIIKSLRSGHDPRAQGTL

SEQ ID NO: 52259 - protein, 209 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEAQGGLANIAILNNNLNTLIQRSNHTQATNDPPEVTVFPKEPVELGQPNTLICHIDKFFPPVLNVTWLCNGELVTEGVAESLFLPRTDYSFHKFHYLTFVPSAEDFYDCRVEHWGLDQPLLKHW

SEQ ID NO: 52260 - protein, 260 aa, Homo sapiens; identical to SEQ ID NO: 52255

SEQ ID NO: 52261 - protein, 23 aa, Homo sapiens
MRPEDRMFHIRAVILRALSLAFL

SEQ ID NO: 52262 - protein, 260 aa, Homo sapiens; identical to SEQ ID NO: 52255

SEQ ID NO: 52263 - protein, 128 aa, Homo sapiens; identical to SEQ ID NO: 52258
  MOD_RES (1)..(1): Any amino acid

SEQ ID NO: 52264 - protein, 260 aa, Homo sapiens; identical to SEQ ID NO: 52255

SEQ ID NO: 52265 - protein, 23 aa, Homo sapiens
MRPEDRMFHIRAVILRALSLAFL

SEQ ID NO: 52266 - protein, 209 aa, Homo sapiens; identical to SEQ ID NO: 52259

SEQ ID NO: 52267 - protein, 23 aa, Homo sapiens
MRPEDRMFHIRAVILRALSLAFL

SEQ ID NO: 52268 - protein, 128 aa, Homo sapiens; identical to SEQ ID NO: 52258
  MOD_RES (1)..(1): Any amino acid

SEQ ID NO: 52269 - protein, 260 aa, Homo sapiens; identical to SEQ ID NO: 52255

SEQ ID NO: 52270 - protein, 128 aa, Homo sapiens; identical to SEQ ID NO: 52258
  MOD_RES (1)..(1): Any amino acid

SEQ ID NO: 52271 - protein, 23 aa, Homo sapiens
MRPEDRMFHIRAVILRALSLAFL

SEQ ID NO: 52272 - protein, 209 aa, Homo sapiens; identical to SEQ ID NO: 52259

SEQ ID NO: 52273 - protein, 212 aa, Homo sapiens
MRPEDRMFHIRAVILRALSLAFLLSLRGAGAIKADHVSTYAAFVQTHRPTGEFMFEFDEDEMFYVDLDKKETVWHLEEFGQAFSFEVTVFPKEPVELGQPNTLICHIDKFFPPVLNVTWLCNGELVTEGVAESLFLPRTDYSFHKFHYLTFVPSAEDFYDCRVEHWGLDQPLLKHWEAQEPIQMPETTETVLCALGLVLGLVGIIVGTVLII

SEQ ID NO: 52274 - protein, 212 aa, Homo sapiens; identical to SEQ ID NO: 52273

SEQ ID NO: 52275 - protein, 128 aa, Homo sapiens; identical to SEQ ID NO: 52258
  MOD_RES (1)..(1): Any amino acid

SEQ ID NO: 52276 - protein, 212 aa, Homo sapiens; identical to SEQ ID NO: 52273

SEQ ID NO: 52277 - protein, 209 aa, Homo sapiens; identical to SEQ ID NO: 52259

SEQ ID NO: 52278 - protein, 23 aa, Homo sapiens
MRPEDRMFHIRAVILRALSLAFL

SEQ ID NO: 52279 - protein, 212 aa, Homo sapiens; identical to SEQ ID NO: 52273

SEQ ID NO: 52280 - protein, 209 aa, Homo sapiens; identical to SEQ ID NO: 52259

SEQ ID NO: 52281 - protein, 128 aa, Homo sapiens; identical to SEQ ID NO: 52258
  MOD_RES (1)..(1): Any amino acid

SEQ ID NO: 52282 - protein, 260 aa, Homo sapiens; identical to SEQ ID NO: 52255

SEQ ID NO: 52283 - protein, 212 aa, Homo sapiens; identical to SEQ ID NO: 52273

SEQ ID NO: 52284 - protein, 23 aa, Homo sapiens
MRPEDRMFHIRAVILRALSLAFL

SEQ ID NO: 52285 - protein, 212 aa, Homo sapiens; identical to SEQ ID NO: 52273

SEQ ID NO: 52286 - protein, 23 aa, Homo sapiens
MRPEDRMFHIRAVILRALSLAFL

SEQ ID NO: 52287 - protein, 212 aa, Homo sapiens; identical to SEQ ID NO: 52273

SEQ ID NO: 52288 - protein, 128 aa, Homo sapiens; identical to SEQ ID NO: 52258
  MOD_RES (1)..(1): Any amino acid

SEQ ID NO: 52289 - protein, 209 aa, Homo sapiens; identical to SEQ ID NO: 52259

SEQ ID NO: 52290 - protein, 260 aa, Homo sapiens; identical to SEQ ID NO: 52255

SEQ ID NO: 52291 - protein, 128 aa, Homo sapiens; identical to SEQ ID NO: 52258
  MOD_RES (1)..(1): Any amino acid

SEQ ID NO: 52292 - protein, 209 aa, Homo sapiens; identical to SEQ ID NO: 52259

SEQ ID NO: 52293 - protein, 209 aa, Homo sapiens; identical to SEQ ID NO: 52259

SEQ ID NO: 52294 - protein, 260 aa, Homo sapiens; identical to SEQ ID NO: 52255

SEQ ID NO: 52295 - protein, 212 aa, Homo sapiens; identical to SEQ ID NO: 52273

SEQ ID NO: 52296 - protein, 260 aa, Homo sapiens; identical to SEQ ID NO: 52255

SEQ ID NO: 52297 - protein, 260 aa, Homo sapiens; identical to SEQ ID NO: 52255

SEQ ID NO: 52298 - protein, 260 aa, Homo sapiens; identical to SEQ ID NO: 52255

SEQ ID NO: 52299 - protein, 260 aa, Homo sapiens; identical to SEQ ID NO: 52255

SEQ ID NO: 52300 - protein, 260 aa, Homo sapiens; identical to SEQ ID NO: 52255

SEQ ID NO: 52301 - protein, 260 aa, Homo sapiens; identical to SEQ ID NO: 52255

SEQ ID NO: 52302 - protein, 258 aa, Homo sapiens
MMVLQVSAAPRTVALTALLMVLLTSVVQGRATPENYVYQLRQECYAFNGTQRFLERYIYNREEFVRFDSDVGEFRAVTELGRPDEDYWNSQKDLLEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 52303 - protein, 228 aa, Homo sapiens
MMVLQVSAAPRTVALTALLMVLLTSVVQGRATPENYLFQGRQECYAFNGTQRFLERYIYNREELVRFDSDVGEFRAVTELGRPEAEYWNSQKDILEEERAVPDRMCRHNYELGGPMTLQRRGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 52304 - protein, 258 aa, Homo sapiens
MMVLQVSAAPRTVALTALLMVLLTSVVQGRATPENYLFQGRQECYAFNGTQRFLERYIYNREELVRFDSDVGEFRAVTELGRPEAEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 52305 - protein, 229 aa, Homo sapiens
KQAWRGSATRLGPQNSGRQECYAFNGTQRFLERYIYNREELVRFDSDVGEFRAVTELGRPEAEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKK

SEQ ID NO: 52306 - protein, 228 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 52307 - protein, 228 aa, Homo sapiens
MMVLQVSAAPRTVALTALLMVLLTSVVQGRATPENYLFQGRQECYAFNGTQRFLERYIYNREEFVRFDSDVGEFRAVTELGRPDEEYWNSQKDILEEKRAVPDRMCRHNYELGGPMTLQRRGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKKVQRGSA

SEQ ID NO: 52308 - protein, 235 aa, Homo sapiens
  MOD_RES (1)..(1): Any amino acid
XNYLFQGRQECYAFNGTQRFLERYIYNREEFVRFDSDVGEFRAVTELGRPDEEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKKGEKACRFNEDLHKQGS

SEQ ID NO: 52309 - protein, 258 aa, Homo sapiens
MMVLQVSAAPRTVALTALLMVLLTSVVQGRATPENYLFQGRQECYAFNGTQRFLERYIYNREEFVRFDSDVGEFRAVTELGRPDEEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKKVQRGSA

SEQ ID NO: 52310 - protein, 228 aa, Homo sapiens; identical to SEQ ID NO: 52306

SEQ ID NO: 52311 - protein, 229 aa, Homo sapiens
KQAWRGSATRLGPQNSGRQECYAFNGTQRFLERYIYNREEFVRFDSDVGEFRAVTELGRPDEEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKK

SEQ ID NO: 52312 - protein, 258 aa, Homo sapiens
MMVLQVSAAPRTVALTALLMVLLTSVVQGRATPENYLFQGRQECYAFNGTQRFLERYIYNREEFVRFDSDVGEFRAVTELGRPDEEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 52313 - protein, 235 aa, Homo sapiens
  MOD_RES (1)..(1): Any amino acid
XNYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKGEKACRFNEDLHKQGS

SEQ ID NO: 52314 - protein, 229 aa, Homo sapiens
KQAWRGSATRLGPQNSGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKK

SEQ ID NO: 52315 - protein, 258 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 52316 - protein, 82 aa, Homo sapiens
MTPQQGDVYTCQVEHTSLDSPVTVEWKAQSDSARSKTLTGAGGRAGAHHLWSGHLHAQEEQESSTRICINRVPELTEKTIVP

SEQ ID NO: 52317 - protein, 258 aa, Homo sapiens; identical to SEQ ID NO: 52309

SEQ ID NO: 52318 - protein, 229 aa, Homo sapiens; identical to SEQ ID NO: 52314

SEQ ID NO: 52319 - protein, 235 aa, Homo sapiens
  MOD_RES (1)..(1): Any amino acid
XNYLFQGRQECYAFNGTQRFLERYIYNREELVRFDSDVGEFRAVTELGRPEAEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKGEKACRFNEDLHKQGS

SEQ ID NO: 52320 - protein, 258 aa, Homo sapiens; identical to SEQ ID NO: 52315

SEQ ID NO: 52321 - protein, 235 aa, Homo sapiens
  MOD_RES (1)..(1): Any amino acid
XNYVYQLRQECYAFNGTQRFLERYIYNREEFVRFDSDVGEFRAVTELGRPDEDYWNSQKDLLEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKGEKACKFNEDLHKQGS

SEQ ID NO: 52322 - protein, 229 aa, Homo sapiens
KQAWRGSATRLGPQNSGRQECYAFNGTQRFLERYIYNREEFVRFDSDVGEFRAVTELGRPDEEYWNSQKDILEEKRAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSMDSPVTVEWKAQSDSARSKTLTGAGGFVLGLIICGVGIFMHRRSKK

SEQ ID NO: 52323 - protein, 228 aa, Homo sapiens
MMVLQVSAAPRTVALTALLMVLLTSVVQGRATPENYVYQLRQECYAFNGTQRFLERYIYNREEFVRFDSDVGEFRAVTELGRPDEDYWNSQKDLLEEKRAVPDRVCRHNYELDEAVTLQRRGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKVQRGSA

SEQ ID NO: 52324 - protein, 228 aa, Homo sapiens; identical to SEQ ID NO: 52307

SEQ ID NO: 52325 - protein, 228 aa, Homo sapiens; identical to SEQ ID NO: 52306

SEQ ID NO: 52326 - protein, 229 aa, Homo sapiens; identical to SEQ ID NO: 52322

SEQ ID NO: 52327 - protein, 235 aa, Homo sapiens
  MOD_RES (1)..(1): Any amino acid
XNYLFQGRQECYAFNGTQRFLERYIYNREEFVRFDSDVGEFRAVTELGRPDEEYWNSQKDILEEERAVPDRMCRHNYELGGPMTLQRRVQPRVNVSPSKKGPLQHHNLLVCHVTDFYPGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKGEKACRFNEDLHKQGS

SEQ ID NO: 52328 - protein, 235 aa, Homo sapiens; identical to SEQ ID NO: 52313
  MOD_RES (1)..(1): Any amino acid

SEQ ID NO: 52329 - protein, 228 aa, Homo sapiens
MMVLQVSAAPRTVALTALLMVLLTSVVQGRATPENYLFQGRQECYAFNGTQRFLERYIYNREEFVRFDSDVGEFRAVTELGRPDEEYWNSQKDILEEERAVPDRMCRHNYELGGPMTLQRRGSIQVRWFLNGQEETAGVVSTNLIRNGDWTFQILVMLEMTPQQGDVYTCQVEHTSLDSPVTVEWKAQSDSARSKTLTGAGGFVLGLIICGVGIFMHRRSKKVQRGSA

SEQ ID NO: 52330 - protein, 229 aa, Homo sapiens
KQAWRGSATRLGPQNSLRQECYAFNGTQRFLERYIYNREEFVRFDSDVGEFRAVTELGRPDEDYWNSQKDLLEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKK

SEQ ID NO: 52331 - protein, 258 aa, Homo sapiens; identical to SEQ ID NO: 52315

SEQ ID NO: 52332 - protein, 235 aa, Homo sapiens; identical to SEQ ID NO: 52308
  MOD_RES (1)..(1): Any amino acid

SEQ ID NO: 52333 - protein, 229 aa, Homo sapiens; identical to SEQ ID NO: 52314

SEQ ID NO: 52334 - protein, 235 aa, Homo sapiens; identical to SEQ ID NO: 52313
  MOD_RES (1)..(1): Any amino acid

SEQ ID NO: 52335 - protein, 123 aa, Homo sapiens
MMVLQVSAAPRTVALTALLMVLLTSVVQGRATPENYLFQGRQECYAFNGTQRFLERYIYNREEFARFDSDVGEFRAVTELGRPAAEYWNSQKDILEEKRAVPDRMCRHNYELGGPMTLQRRGE

SEQ ID NO: 52336 - protein, 82 aa, Homo sapiens; identical to SEQ ID NO: 52316

SEQ ID NO: 52337 - protein, 82 aa, Homo sapiens; identical to SEQ ID NO: 52316

SEQ ID NO: 52338 - protein, 123 aa, Homo sapiens
MMVLQVSAAPRTVALTALLMVLLTSVVQGRATPENYLFQGRQECYAFNGTQRFLERYIYNREELVRFDSDVGEFRAVTELGRPEAEYWNSQKDILEEERAVPDRMCRHNYELGGPMTLQRRGE

SEQ ID NO: 52339 - protein, 123 aa, Homo sapiens
MMVLQVSAAPRTVALTALLMVLLTSVVQGRATPENYLFQGRQECYAFNGTQRFLERYIYNREEFVRFDSDVGEFRAVTELGRPDEEYWNSQKDILEEKRAVPDRMCRHNYELGGPMTLQRRGE

SEQ ID NO: 52340 - protein, 123 aa, Homo sapiens
MMVLQVSAAPRTVALTALLMVLLTSVVQGRATPENYLFQGRQECYAFNGTQRFLERYIYNREEFVRFDSDVGEFRAVTELGRPDEEYWNSQKDILEEERAVPDRMCRHNYELGGPMTLQRRGE

SEQ ID NO: 52341 - protein, 249 aa, Homo sapiens
MVLLTSVVQGRATPENYVYQLRQECYAFNGTQRFLERYIYNREEFVRFDSDVGEFRAVTELGRPDEDYWNSQKDLLEEKRAVPDRVCRHNYELDEAVTLQRRVQPKVNVSPSKKGPLQHHNLLVCHVTDFYPGSIQVRWFLNGQEETAGVVSTNLIRNGDWTFQILVMLEMTPQQGDVYICQVEHTSLDSPVTVEWKAQSDSARSKTLTGAGGFVLGLIICGVGIFMHRRSKKGEKACKFNEDLHKQGS

SEQ ID NO: 52342 - protein, 82 aa, Homo sapiens; identical to SEQ ID NO: 52316

SEQ ID NO: 52343 - protein, 123 aa, Homo sapiens; identical to SEQ ID NO: 52335

SEQ ID NO: 52344 - protein, 123 aa, Homo sapiens; identical to SEQ ID NO: 52335

SEQ ID NO: 52345 - protein, 65 aa, Homo sapiens
MDSPVTVEWKAQSDSARSKTLTGAGGRAGAHHLWSGHLHAQEEQESSTRICINRVPELTEKTIVP

SEQ ID NO: 52346 - protein, 126 aa, Homo sapiens
MMVLQVSAAPRTVALTALLMVLLTSVVQGRATPENYVYQLRQECYAFNGTQRFLERYIYNREEFVRFDSDVGEFRAVTELGRPDEDYWNSQKDLLEEKRAVPDRVCRHNYELDEAVTLQRRERGKK

SEQ ID NO: 52347 - protein, 82 aa, Homo sapiens
MTPQQGDVYICQVEHTSLDSPVTVEWKAQSDSARSKTLTGAGGRAGAHHLWSGHLHAQEEQESSTRICINRVPDLTEKTNVP

SEQ ID NO: 52348 - protein, 82 aa, Homo sapiens; identical to SEQ ID NO: 52316

SEQ ID NO: 52349 - protein, 123 aa, Homo sapiens; identical to SEQ ID NO: 52339

SEQ ID NO: 52350 - protein, 65 aa, Homo sapiens; identical to SEQ ID NO: 52345

SEQ ID NO: 52351 - protein, 255 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWEPEIPAPMSELTETVVCALGLSVGLMGIVVGTVFIIQGLRSVGASRHQGPL

SEQ ID NO: 52352 - protein, 255 aa, Homo sapiens; identical to SEQ ID NO: 52351

SEQ ID NO: 52353 - protein, 254 aa, Homo sapiens
MILNKALMLGALALTTVMSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWEPEIPAPMSELTETVVCALGLSVGLVGIVVGTVFIIRGLRSVGASRHQGPL

SEQ ID NO: 52354 - protein, 255 aa, Homo sapiens; identical to SEQ ID NO: 52351

SEQ ID NO: 52355 - protein, 255 aa, Homo sapiens; identical to SEQ ID NO: 52351

SEQ ID NO: 52356 - protein, 254 aa, Homo sapiens; identical to SEQ ID NO: 52353

SEQ ID NO: 52357 - protein, 254 aa, Homo sapiens; identical to SEQ ID NO: 52353

SEQ ID NO: 52358 - protein, 24 aa, Homo sapiens
MILNKALMLGALALTTVMSPCGGE

SEQ ID NO: 52359 - protein, 254 aa, Homo sapiens
MILNKALMLGALALTTVMSPCGGEDIVADHVASYGVNLYQSYGPSGQFTHEFDGDEEFYVDLERKETVWKLPLFHRLRFDPQFALTNIAVLKHNLNILIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETVVCALGLSVGLVGIVVGTVLIIRGLRSVGASRHQGPL

SEQ ID NO: 52360 - protein, 255 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWEPEIPTPMSELTETVVCALGLSVGLVGIVVGTVLIIRGLRSVGASRHQGPL

SEQ ID NO: 52361 - protein, 255 aa, Homo sapiens
MILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSDDEIYDCKVEHWGLDEPLLKHWEPEIPTPMSELTETVVCALGLSVGLVGIVVGTVLIIRGLRSVGASRHQGPL

SEQ ID NO: 52362 - protein, 24 aa, Homo sapiens
MILNKALLLGALALTTVMSPCGGE

SEQ ID NO: 52363 - protein, 255 aa, Homo sapiens; identical to SEQ ID NO: 52361

SEQ ID NO: 52364 - protein, 254 aa, Homo sapiens; identical to SEQ ID NO: 52359

SEQ ID NO: 52365 - protein, 254 aa, Homo sapiens; identical to SEQ ID NO: 52359

SEQ ID NO: 52366 - protein, 254 aa, Homo sapiens; identical to SEQ ID NO: 52359

SEQ ID NO: 52367 - protein, 255 aa, Homo sapiens; identical to SEQ ID NO: 52360

SEQ ID NO: 52368 - protein, 24 aa, Homo sapiens
MILNKALMLGALALTTVMSPCGGE

SEQ ID NO: 52369 - protein, 24 aa, Homo sapiens
MILNKALMLGALALTTVMSPCGGE

SEQ ID NO: 52370 - protein, 255 aa, Homo sapiens; identical to SEQ ID NO: 52361

SEQ ID NO: 52371 - protein, 254 aa, Homo sapiens; identical to SEQ ID NO: 52359

SEQ ID NO: 52372 - protein, 254 aa, Homo sapiens; identical to SEQ ID NO: 52359

SEQ ID NO: 52373 - protein, 254 aa, Homo sapiens; identical to SEQ ID NO: 52359

SEQ ID NO: 52374 - protein, 255 aa, Homo sapiens; identical to SEQ ID NO: 52361

SEQ ID NO: 52375 - protein, 254 aa, Homo sapiens; identical to SEQ ID NO: 52359

SEQ ID NO: 52376 - protein, 214 aa, Homo sapiens
MILNKALLLGALALTTVMSPCGGEDIVADHVASCGVNLYQFYGPSGQYTHEFDGDEQFYVDLERKETAWRWPEFSKFGGFDPQGALRNMAVAKHNLNIMIKRYNSTAATNEVPEVTVFSKSPVTLGQPNTLICLVDNIFPPVVNITWLSNGQSVTEGVSETSFLSKSDHSFFKISYLTFLPSADEIYDCKVEHWGLDQPLLKHWGASPSTGAEE

SEQ ID NO: 52377 - protein, 191 aa, Homo sapiens
MSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWGLLH

SEQ ID NO: 52378 - protein, 146 aa, Homo sapiens [sequence omitted]

SEQ ID NO: 52379 - protein, 253 aa, Homo sapiens
GCLGKRMILNKALMLGALALTTVMSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWGKDEFHHFLMLSCLSSSELPAFYSYIPKLVFHTSWVSFFLIFFF

SEQ ID NO: 52380 - protein, 200 aa, Homo sapiens
MSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWESQSRESEESTKS

SEQ ID NO: 52381 - protein, 193 aa, Homo sapiens
MSPCGGEDIVADHVASYGVNLYQSYGPSGQYTHEFDGDEQFYVDLGRKETVWCLPVLRQFRFDPQFALTNIAVLKHNLNSLIKRSNSTAATNEVPEVTVFSKSPVTLGQPNILICLVDNIFPPVVNITWLSNGHSVTEGVSETSFLSKSDHSFFKISYLTLLPSAEESYDCKVEHWGLDKPLLKHWVHGFLSF

SEQ ID NO: 52382 - protein, 201 aa, Homo sapiens
MSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPVTLGQPNTLICLVDNIFPPVVNITWLSNGHSVTEGVSETSFLSKSDHSFFKISYLTFLPSADEIYDCKVEHWGLDEPLLKHWGIQAEEGQRRKKLG

SEQ ID NO: 52383 - protein, 85 aa, Homo sapiens
NTLICLVDNIFPPVVNITWLSNGHSVTEGVSETSFLSKSDHSFFKISYLTFLPSADEIYDCKVEHWGLDEPLLKHWGKDFMSFFY

SEQ ID NO: 52384 - protein, 129 aa, Homo sapiens
GCLGKRMILNKALMLGALALTTVMSPCGGEDIVADHVASYGVNLYQSYGPSGQYSHEFDGDEEFYVDLERKETVWQLPLFRRFRRFDPQFALTNIAVLKHNLNIVIKRSNSTAATNEVPEVTVFSKSPV

SEQ ID NO: 52385 - protein, 255 aa, Homo sapiens
MILNKALLLGALALTAVMSPCGGEDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVDASRHQGLL

SEQ ID NO: 52386 - protein, 255 aa, Homo sapiens
MILNKALLLGALALTAVMSPCGGEDIVADHVASYGVNFYQSHGPSGQYTHEFDGDEEFYVDLETKETVWQLPMFSKFISFDPQSALRNMAVGKHTLEFMMRQSNSTAATNEVPEVTVFSKFPVTLGQPNTLICLVDNIFPPVVNITWLSNGHSVTEGVSETSFLSKSDHSFFKISYLTFLPSADEIYDCKVEHWGLDEPLLKHWEPEIPAPMSELTETLVCALGLSVGLMGIVVGTVFIIQGLRSVGASRHQGLL

SEQ ID NO: 52387 - protein, 255 aa, Homo sapiens [sequence omitted]

SEQ ID NO: 52388 - protein, 255 aa, Homo sapiens; identical to SEQ ID NO: 52386

SEQ ID NO: 52389 - protein, 255 aa, Homo sapiens [sequence omitted]

SEQ ID NO: 52390 - protein, 255 aa, Homo sapiens; identical to SEQ ID NO: 52386

SEQ ID NO: 52391 - protein, 255 aa, Homo sapiens; identical to SEQ ID NO: 52386

SEQ ID NO: 52392 - protein, 255 aa, Homo sapiens [sequence omitted]

SEQ ID NO: 52393 - protein, 255 aa, Homo sapiens; identical to SEQ ID NO: 52386

SEQ ID NO: 52394 - protein, 82 aa, Homo sapiens
DHVASYGVNFYQSHGPSGQYTHEFDGDEEFYVDLETKETVWQLPMFSKFISFDPQSALRNMAVGKHTLEFMMRQSNSTAATN

SEQ ID NO: 52395 - protein, 255 aa, Homo sapiens; identical to SEQ ID NO: 52386

SEQ ID NO: 52396 - protein, 27 aa, Homo sapiens
MILNKALLLGALALTAVMSPCGGEDIV

SEQ ID NO: 52397 - protein, 269 aa, Homo sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGPQGPPPAGLLH

SEQ ID NO: 52398 - protein, 261 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 52399 - protein, 261 aa, Homo sapiens; identical to SEQ ID NO: 52398

SEQ ID NO: 52400 - protein, 269 aa, Homo sapiens
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRAQSESAQSKMLSGIGGFVLGLIFLGLGLIIHHRSQKGPQGPPPAGLLH

SEQ ID NO: 52401 - protein, 269 aa, Homo sapiens
MSWKKALRIPGGLRVATVTLMLAMLSTPVAEGRDSPEDFVYQFKGMCYFTNGTERVRLVTRYIYNREEYARFDSDVGVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRAQSESAQSKMLSGIGGFVLGLIFLGLGLIIHHRSQKGPQGPPPAGLLH

SEQ ID NO: 52402 - protein, 224 aa, Homo sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRLLH

SEQ ID NO: 52403 - protein, 261 aa, Homo sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVEHPSLQSPITVEWRAQSESAQSKMLSGVGGFVLGLIFLGLGLIIRQRSQKGLLH

SEQ ID NO: 52404 - protein, 261 aa, Homo sapiens
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRAQSESAQSKMLSGIGGFVLGLIFLGLGLIIHHRSQKGLLH

SEQ ID NO: 52405 - protein, 224 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRLLH

SEQ ID NO: 52406 - protein, 261 aa, Homo sapiens; identical to SEQ ID NO: 52404

SEQ ID NO: 52407 - protein, 261 aa, Homo sapiens
MSWKKALRIPGGLRVATVTLMLAMLSTPVAEGRDSPEDFVYQFKGMCYFTNGTERVRGVTRYIYNREEYARFDSDVGVYRAVTPLGPPAAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRAQSESAQSKMLSGIGGFVLGLIFLGLGLIIHHRSQKGLLH

SEQ ID NO: 52408 - protein, 224 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRLLH

SEQ ID NO: 52409 - protein, 261 aa, Homo sapiens [sequence omitted]

SEQ ID NO: 52410 - protein, 261 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 52411 - protein, 269 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRAQSESAQSKMLSGIGGFVLGLIFLGLGLIIHHRSQKGPQGPPPAGLLH

SEQ ID NO: 52412 - protein, 261 aa, Homo sapiens [sequence omitted]

SEQ ID NO: 52413 - protein, 224 aa, Homo sapiens
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRLLH

SEQ ID NO: 52414 - protein, 261 aa, Homo sapiens; identical to SEQ ID NO: 52410

SEQ ID NO: 52415 - protein, 134 aa, Homo sapiens
MSWKKALRIPGGLRAATVTLMLSMLSTPVAEGRDSPVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRLLH

SEQ ID NO: 52416 - protein, 134 aa, Homo sapiens
MSWKKALRIPGGLRVATVTLMLAMLSTPVAEGRDSPVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRLLH

SEQ ID NO: 52417 - protein, 144 aa, Homo sapiens
MSWKKALRIPGGLRVATVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVE

SEQ ID NO: 52418 - protein, 134 aa, Homo sapiens
MSWKKALRIPGGLRAATVTLMLAMLSTPVAEGRDSPVEPTVTISPSRTEALNHHNLLVCSVTDFYPAQIKVRWFRNDQEETTGVVSTPLIRNGDWTFQILVMLEMTPQHGDVYTCHVEHPSLQNPITVEWRLLH

SEQ ID NO: 52419 - protein, 261 aa, Homo sapiens; identical to SEQ ID NO: 52403

SEQ ID NO: 52420 - protein, 224 aa, Homo sapiens
MSWKKALRIPGGLRVATVTLMLAMLSTPVAEGRDSPEDFVYQFKGMCYFTNGTERVRLVTRYIYNREEYARFDSDVGVYRAVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRLLH

SEQ ID NO: 52421 - protein, 144 aa, Homo sapiens
MSWKKALRIPGDLRVATVTPQGRPDAEYWNSQKEVLEGTRAELDTVCRHNYEVAFRGILQRRVEPTVTISPSRTEALNHHNLLVCSVTDFYPGQIKVRWFRNDQEETAGVVSTPLIRNGDWTFQILVMLEMTPQRGDVYTCHVE

SEQ ID NO: 52422 - protein, 144 aa, Homo sapiens
MSWKKALRIPGGLRAATVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVE

SEQ ID NO: 52423 - protein, 144 aa, Homo sapiens
MSWKKALRIPGGLRAATVTPLGPPDAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQHGDVYTCHVE

SEQ ID NO: 52424 - protein, 136 aa, Homo sapiens
MSWKKALRIPGGLRAATVTLMLSMLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRGMVTGPSRSW

SEQ ID NO: 52425 - protein, 136 aa, Homo sapiens
MSWKKALRIPGGLRAATVTLMLAMLSTPVAEGRDSPEDFVYQFKAMCYFTNGTERVRYVTRYIYNREEYARFDSDVEVYRAVTPLGPPDAEYWNSQKEVLERTRAELDTVCRHNYQLELRTTLQRRGTVTGPSRSW

SEQ ID NO: 52426 - protein, 136 aa, Homo sapiens
MSWKKALRIPGDLRVATVTLMLAMLSSLLAEGRDSPEDFVFQFKGMCYFTNGTERVRLVTRYIYNREEYARFDSDVGVYRAVTPQGRPDAEYWNSQKEVLEGTRAELDTVCRHNYEVAFRGILQRRGMVTGLSRSW

SEQ ID NO: 52427 - protein, 238 aa, Homo sapiens
MLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNGQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 52428 - protein, 180 aa, Homo sapiens
MCYFTNGTERVRGVTRYIYNREEYARFDSDVGVYRAVTPLGPPAAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRMDEF

SEQ ID NO: 52429 - protein, 238 aa, Homo sapiens
MLSTPVAEGRDSPEDFVYQFKGMCYFTNGTERVRLVSRSIYNREEIVRFDSDVGEFRAVTLLGLPAAEYWNSQKDILERKRAAVDRVCRHNYQLELRTTLQRRVEPTVTISPSRTEALNHHNLLVCSVTDFYPAQIKVRWFRNDQEETAGVVSTPLIRNGDWTFQILVMLEMTPQRGDVYTCHVEHPSLQSPITVEWRAQSESAQSKMLSGIGGFVLGLIFLGLGLIIHHRSQKGLLH

SEQ ID NO: 52430 - protein, 247 aa, Homo sapiens
MLSTPVAEGRDSPEDFVYQFKGMCYFTNGTERVRGVTRYIYNREEYARFDSDVGVYRAVTPLGPPAAEYWNSQKEVLERTRAELDTVCRHNYQLELRTTLQRRVEPTVTISPSRTEALNHHNLLVCSVTDFYPAQIKVRWFRNDQEETTGVVSTPLIRNGDWTFQILVMLEMTPQRGDVYTCHVEHPSLQNPIIVEWRAQSESAQSKMLSGIGGFVLGLIFLGLGLIIHHRSQKALPQGPPPAGDIS

SEQ ID NO: 52431 - protein, 238 aa, Homo sapiens; identical to SEQ ID NO: 52429

SEQ ID NO: 52432 - protein, 266 aa, Homo sapiens
MVCLRLPGGSCMAVLTVTLMVLSSPLALAGDTRPRFLEYSTSECHFFNGTERVRYLDRYFHNQEENVRFDSDVGEFRAVTELGRPDAEYWNSQKDLLEQKRGRVDNYCRHNYGVVESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEWRARSESAQSKMLSGVGGFVLGLLFLGAGLFIYFRNQKGHSGLQPRGFLS

SEQ ID NO: 52433 - protein, 266 aa, Homo sapiens
MVCLKLPGGSCMTALTVTLMVLSSPLALSGDTRPRFLWQPKRECHFFNGTERVRFLDRYFYNQEESVRFDSDVGEFRAVTELGRPDAEYWNSQKDILEQARAAVDTYCRHNYGVVESFTVQRRVQPKVTVYPSKTQPLQHHNLLVCSVSGFYPGSIEVRWFLNGQEEKAGMVSTGLIQNGDWTFQTLVMLETVPRSGEVYTCQVEHPSVTSPLTVEWRARSESAQSKMLSGVGGFVLGLLFLGAGLFIYFRNQKGHSGLQPTGFLS

SEQ ID NO: 52434 - protein, 266 aa, Homo sapiens; identical to SEQ ID NO: 52432

SEQ ID NO: 52435 - protein, 250 aa, Homo sapiens
LLKLTRDFPQRHEKYQSWAGTFHLCLKKNKYPDSRSTFIKHAGSYLKRGEFLSIHTAITCFFLQISARFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEW

SEQ ID NO: 52436 - protein, 251 aa, Homo sapiens
  MOD_RES (1)..(1): Any amino acid
XLLKLTRDFPQRHEKYQSWAGTFHLCLKKNKYPDSRSTFIKHAGSYLKRGEFLAIHTAITCFFRQISARFLEYSTSECHFFNGTERVRYLDRYFHNQEENVRFDSDVGEFRAVTELGRPDAEYWNSQKDLLEQKRGRVDNYCRHNYGVVESFTVQRRVHPKVTVYPSKTQPLQHHNLLVCSVSGFYPGSIEVRWFRNGQEEKTGVVSTGLIHNGDWTFQTLVMLETVPRSGEVYTCQVEHPSVTSPLTVEW

SEQ ID NO: 52437 - protein, 266 aa, Homo sapiens
MVCLKFPGGSCMAALTVTLMVLSSPLALAGDTRPRFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGFLS

SEQ ID NO: 52438 - protein, 251 aa, Homo sapiens; identical to SEQ ID NO: 52436
  MOD_RES (1)..(1): Any amino acid

SEQ ID NO: 52439 - protein, 250 aa, Homo sapiens
  MOD_RES (1)..(1): Any amino acid
XLLKLTRDFPQRHEKYQSWAGTFHLCLKKNKYPDSRSTFIKHAGSYLKRGEFLSIHTAITCFFLQISARFLWQGKYKCHFFNGTERVQFLERLFYNQEEFVRFDSDVGEYRAVTELGRPVAESWNSQKDILEDRRGQVDTVCRHNYGVGESFTVQRRVHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVE

SEQ ID NO: 52440 - protein, 266 aa, Homo sapiens
MVCLKLPGGSCMAALTVTLMVLSSPLALAGDTQPRFLWQGKYKCHFFNGTERVQFLERLFYNQEEFVRFDSDVGEYRAVTELGRPVAESWNSQKDILEDRRGQVDTVCRHNYGVGESFTVQRRVHPEVTVYPAKTQPLQHHNLLVCSVSGFYPGSIEVRWFRNGQEEKAGVVSTGLIQNGDWTFQTLVMLETVPRSGEVYTCQVEHPSVMSPLTVEWRARSESAQSKMLSGVGGFVLGLLFLGAGLFIYFRNQKGHSGLQPTGFLS

SEQ ID NO: 52441 - protein, 266 aa, Homo sapiens; identical to SEQ ID NO: 52440

SEQ ID NO: 52442 - protein, 269 aa, Homo sapiens
MSWKKALRIPGGLRVATVTLMLAMLSTPVAEGRDSPEDFVYQFKGMCYFTNGTERVRGVTRYIYNREEYARFDSDVGVYRAVTPLGPPAAEYWNSQKEVLERTRAELDTVCRHNYQLELRTTLQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGFLS

SEQ ID NO: 52443 - protein, 263 aa, Homo sapiens
MVCLKFPGGSCMAALTVTLMVLSSPLALAGDTRPRFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTG

SEQ ID NO: 52444 - protein, 46 aa, Homo sapiens
HSGLQPTGNTFSSSLRNRFGGQAQHACNPSTLGGRGGRIMRIPELK

SEQ ID NO: 52445 - protein, 296 aa, Homo sapiens
MVCLKFPGGSCMAALTVTLMVLSSPLALAGDTRPRFLEQVKHECHFFNGTERVRFLDRYFYHQEEYVRFDSDVGEYRAVTELGRPDAEYWNSQKDLLEQRRAEVDTYCRHNYGVVESFTVQRRVYPEVTVYPAKTQPLQHHNLLVCSVNGFYPGSIEVRWFRNGQEEKTGVVSTGLIQNGDWTFQTLVMLETVPRSGEVYTCQVEHPSLTSPLTVEWRARSESAQSKMLSGVGGFVLGLLFLGAGLFIYFRNQKGHSGLQPTGNTFSSSLRNRFGGQAQWLTPVIPALWEAEAGES

SEQ ID NO: 52446 - protein, 266 aa, Homo sapiens
MVCLKLPGGSSLAALTVTLMVLSSRLAFAGDTRPRFLELLKSECHFFNGTERVRFLERHFHNQEEYARFDSDVGEYRAVRELGRPDAEYWNSQKDLLEQKRGQVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSPLTVEWSARSESAQSKMLSGVGGFVLGLLFLGAGLFIYFRNQKGHSGLQPTGFLS

SEQ ID NO: 52447 - protein, 266 aa, Homo sapiens
MVCLKLPGGSSLAALTVTLMVLSSRLAFAGDTRPRFLELRKSECHFFNGTERVRYLDRYFHNQEEFLRFDSDVGEYRAVTELGRPVAESWNSQKDLLEQKRGRVDNYCRHNYGVGESFTVQRRVHPQVTVYPAKTQPLQHHNLLVCSVSGFYPGSIEVRWFRNGQEEKAGVVSTGLIQNGDWTFQTLVMLETVPRSGEVYTCQVEHPSVTSALTVEWRARSESAQSKMLSGVGGFVLGLLFLGAGLFIYFRNQKGHSGLQPTGFLS

SEQ ID NO: 52448 - protein, 266 aa, Homo sapiens; identical to SEQ ID NO: 52446

SEQ ID NO: 52449 - protein, 266 aa, Homo sapiens
MVCLKLPGGSYMAKLTVTLMVLSSPLALAGDTRPRFLQQDKYECHFFNGTERVRFLHRDIYNQEEDLRFDSDVGEYRAVTELGRPDAEYWNSQKDFLEDRRAAVDTYCRHNYGVGESFTVQRRVEPKVTVYPARTQTLQHHNLLVCSVNGFYPGSIEVRWFRNSQEEKAGVVSTGLIQNGDWTFQTLVMLETVPRSGEVYTCQVEHPSVTSPLTVEWRAQSESAQSKMLSGVGGFVLGLLFLGAGLFIYFKNQKGHSGLHPTGLVS

SEQ ID NO: 52450 - protein, 296 aa, Homo sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 52451 - protein, 341 aa, Homo sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEPPLVRVNRKETFPGVTALFCKAHGFYPPEIYMTWMKNGEEIVQEIDYGDILPSGDGTYQAWASIELDPQSSNLYSCHVEHCGVHMVLQVPQESETIPLVMKAVSGSIVLVIVLAGVGVLVWRRRPREQNGAIYLPTPDR

SEQ ID NO: 52452 - protein, 214 aa, Homo sapiens
MGELMAFLLPLIIVLMVKHSDSRTHSLRYFRLGVSDPIHGVPEFISVGYVDSHPITTYDSVTRQKEPRAPWMAENLAPDHWERYTQLLRGWQQMFKVELKRLQRHYNHSGSHTYQRMIGCELLEDGSTTGFLQYAYDGQDFLIFNKDTLSWLAVDNVAHTIKQAWEANQHELLYQKNWLEEECIAWLKRFLEYGKDTLQRTEQNGAIYLPTPDR

SEQ ID NO: 52453 - protein, 263 aa, Homo sapiens
MWELRSASFWRAIFAEFFATLFYVFFGLGSSLRWAPGPLHVLQVAMAFGLALATLVQSVGHISGAHVNPAVTFAFLVGSQMSLLRAFCYMAAQLLGAVAGAAVLYSVTPPAVRGNLALNTLHPAVSVGQATTVEIFLTLQFVLCIFATYDERRNGQLGSVALAVGFSLALGHLFGMYYTGAGMNPARSFAPAILTGNFTNHWVYWVGPIIGGGLGSLLYDFLLFPRLKSISERLSVLKGAKPDVSNGQPEVTGEPVELNTQAL

SEQ ID NO: 52454 - protein, 893 aa, Homo sapiens
MATEEFIIRIPPYHYIHVLDQNSNVSRVEVGPKTYIRQDNERVLFAPMRMVTVPPRHYCTVANPVSRDAQGLVLFDVTGQVRLRHADLEIRLAQDPFPLYPGEVLEKDITPLQVVLPNTALHLKALLDFEDKDGDKVVAGDEWLFEGPGTYIPRKEVEVVEIIQATIIRQNQALRLRARKECWDRDGKERVTGEEWLVTTVGAYLPAVFEEVLDLVDAVILTEKTALHLRARRNFRDFRGVSRRTGEEWLVTVQDTEAHVPDVHEEVLGVVPITTLGPHNYCVILDPVGPDGKNQLGQKRVVKGEKSFFLQPGEQLEQGIQDVYVLSEQQGLLLRALQPLEEGEDEEKVSHQAGDHWLIRGPLEYVPSAKVEVVEERQAIPLDENEGIYVQDVKTGKVRAVIGSTYMLTQDEVLWEKELPPGVEELLNKGQDPLADRGEKDTAKSLQPLAPRNKTRVVSYRVPHNAAVQVYDYREKRARVVFGPELVSLGPEEQFTVLSLSAGRPKRPHARRALCLLLGPDFFTDVITIETADHARLQLQLAYNWHFEVNDRKDPQETAKLFSVPDFVGDACKAIASRVRGAVASVTFDDFHKNSARIIRTAVFGFETSEAKGPDGMALPRPRDQAVFPQNGLVVSSVDVQSVEPVDQRTRDALQRSVQLAIEITTNSQEAAAKHEAQRLEQEARGRLERQKILDQSEAEKARKELLELEALSMAVESTGTAKAEAESRAEAARIEGEGSVLQAKLKAQALAIETEAELQRVQKVRELELVYARAQLELEVSKAQQLAEVEVKKFKQMTEAIGPSTIRDLAVAGPEMQVKLLQSLGLKSTLITDGSTPINLFNTAFGLLGMGPEGQPLGRRVASGPSPGEGISPQSAQAPQAPGDNHVVPVLR

SEQ ID NO: 52455 - protein, 893 aa, Homo sapiens; identical to SEQ ID NO: 52454

SEQ ID NO: 52456 - protein, 159 aa, Homo sapiens
MCWTRTATCPVWRSGQRPTSGRTMRGSGFGGRRHPYGKDSPAPPGSAELPGLQGSVPPHWGGVAGNSAGHRGPRARCPRGGAGGCAHHHPGPPQLLRDSRPCRTGWQESAGAEARGQGREVFFPPARRAAGTRHPGCVCAVGAAGAAAEGPAAPGGGGG

SEQ ID NO: 52457 - protein, 416 aa, Homo sapiens
MSTKQITCRYFMHGVCREGSQCLFSHDLANSKPSTICKYYQKGYCAYGTRCRYDHTRPSAAAGGAVGTMAHSVPSPAFHSPHPPSEVTASIVKTNSHEPGKREKRTLVLRDRNLSGMAERKTQPSMVSNPGSCSDPQPSPEMKPHSYLDAIRSGLDDVEASSSYSNEQQLCPYAAAGECRFGDACVYLHGEVCEICRLQVLHPFDPEQRKAHEKICMLTFEHEMEKAFAFQASQDKVCSICMEVILEKASASERRFGILSNCNHTYCLSCIRQWRCAKQFENPIIKSCPECRVISEFVIPSVYWVEDQNKKNELIEAFKQGMGKKACKYFEQGKGTCPFGSKCLYRHAYPDGRLAEPEKPRKQLSSQGTVRFFNSVRLWDFIENRESRHVPNNEDVDMTELGDLFMHLSGVESSEP

SEQ ID NO: 52458 - protein, 507 aa, Homo sapiens
MEEPAAPSEAHEAAGAQAGAEAAREGVSGPDLPVCEPSGESAAPDSALPHAARGWAPFPVAPVPAHLRRGGLRPAPASGGGAWPSPLPSRSSGIWTKQIICRYYIHGQCKEGENCRYSHDLSGRKMATEGGVSPPGASAGGGPSTAAHIEPPTQEVAEAPPAASSLSLPVIGSAAERGFFEAERDNADRGAAGGAGVESWADAIEFVPGQPYRGRWVASAPEAPLQSSETERKQMAVGSGLRFCYYASRGVCFRGESCMYLHGDICDMCGLQTLHPMDAAQREEHMRACIEAHEKDMELSFAVQRGMDKVCGICMEVVYEKANPNDRRFGILSNCNHSFCIRCIRRWRSARQFENRIVKSCPQCRVTSELVIPSEFWVEEEEEKQKLIQQYKEAMSNKACRYFAEGRGNCPFGDTCFYKHEYPEGWGDEPPGPGGGSFSAYWHQLVEPVRMGEGNMLYKSIKKELVVLRLASLLFKRFLSLRDELPFSEDQWDLLHYELEEYFNLIL

SEQ ID NO: 52459 - protein, 153 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLDAAYHCTAALFYLSASVLEALATITMQDGFTYRHYHENIAAVVFSYIATLLYVVHAVFSLIRWKSS

SEQ ID NO: 52460 - protein, 55 aa, Homo sapiens
MAPAAATGGSTLPSGFSVFTTLPDLLFIFEFVFSYIATLLYVVHAVFSLIRWKSS

SEQ ID NO: 52461 - protein, 111 aa, Homo sapiens
MAPAAATGGSTLPSGFSVFTTLPDLLFIFEFIFGGLVWILVASSLVPWPLVQGWVMFVSVFCFVATTTLIILYIIGAHGGETSWVTLVFSYIATLLYVVHAVFSLIRWKSS

SEQ ID NO: 52462 - protein, 97 aa, Homo sapiens
MAPAAATGGSTLPSGFSVFTTLPDLLFIFEFDAAYHCTAALFYLSASVLEALATITMQDGFTYRHYHENIAAVVFSYIATLLYVVHAVFSLIRWKSS

SEQ ID NO: 52463 - protein, 153 aa, Homo sapiens
MASPDPPATSYAPSDVPSGVALFLTIPFAFFLPELIFGFLVWTMVAATHIVYPLLQGWVMYVSLTSFLISLMFLLSYLFGFYKRFESWRVLDSLYHGTTGILYMSAAVLQVHATIVSEKLLDPRIYYINSAASFFAFIATLLYILHAFSIYYH

SEQ ID NO: 52464 - protein, 334 aa, Homo sapiens
MSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 52465 - protein, 334 aa, Homo sapiens; identical to SEQ ID NO: 52464

SEQ ID NO: 52466 - protein, 352 aa, Homo sapiens
MRRCSYFPKDVTVFDKDDKSEPIRVLVTGAAGQIAYSLLYSIGNGSVFGKDQPIILVLLDITPMMGVLDGVLMELQDCALPLLKDVIATDKEDVAFKDLDVAILVGSMPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 52467 - protein, 245 aa, Homo sapiens
MPRREGMERKDLLKANVKIFKSQGAALDKYAKKSVKVIVVGNPANTNCLTASKSAPSIPKENFSCLTRLDHNRAKAQIALKLGVTANDVKNVIIWGNHSSTQYPDVNHAKVKLQGKEVGVYEALKDDSWLKGEFVTTVQQRGAAVIKARKLSSAMSAAKAICDHVRDIWFGTPEGEFVSMGVISDGNSYGVPDDLLYSFPVVIKNKTWKFVEGLPINDFSREKMDLTAKELTEEKESAFEFLSSA

SEQ ID NO: 52468 - protein, 338 aa, Homo sapiens
MLSALARPASAALRRSFSTSAQNNAKVAVLGASGGIGQPLSLLLKNSPLVSRLTLYDIAHTPGVAADLSHIETKAAVKGYLGPEQLPDCLKGCDVVVIPAGVPRKPGMTRDDLFNTNATIVATLTAACAQHCPEAMICVIANPVNSTIPITAEVFKKHGVYNPNKIFGVTTLDIVRANTFVAELKGLDPARVNVPVIGGHAGKTIIPLISQCTPKVDFPQDQLTALTGRIQEAGTEVVKAKAGAGSATLSMAYAGARFVFSLVDAMNGKEGVVECSFVKSQETECTYFSTPLLLGKKGIEKNLGIGKVSSFEEKMISDAIPELKASIKKGEDFVKTLK

SEQ ID NO: 52469 - protein, 623 aa, Homo sapiens
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRLPEPVPSGSNHSTGENKSLPAVTSLKSDSELSTAPTSKQYYLKQSRYLPGVNPKKVSLIASGKEINPHTWSNQLFPKSLGPVGAELAFKRSNAGNLGSYATYNQSGYIPSFLKKEVQSAGQRIHLAPLNATASEYTWNTKTGRGQFSGRTYNPTAKNLNIVNRAQPIPSVHGRTDWVAKYGGHR

SEQ ID NO: 52470 - protein, 623 aa, Homo sapiens; identical to SEQ ID NO: 52469

SEQ ID NO: 52471 - protein, 288 aa, Homo sapiens
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQPCFLVEVERPN

SEQ ID NO: 52472 - protein, 457 aa, Homo sapiens
MNRYTTMRQLGDGTYGSVLMGKSNESGELVAIKRMKRKFYSWDECMNLREVKSLKKLNHANVIKLKEVIRENDHLYFIFEYMKENLYQLMKDRNKLFPESVIRNIMYQILQGLAFIHKHGFFHRDMKPENLLCMGPELVKIADFGLARELRSQPPYTDYVSTRWYRAPEVLLRSSVYSSPIDVWAVGSIMAELYMLRPLFPGTSEVDEIFKICQVLGTPKKSDWPEGYQLASSMNFRFPQCVPINLKTLIPNASNEAIQLMTEMLNWDPKKRPTASQALKHPYFQVGQVLGPSSNHLESKQSLNKQLQPLESKPSLVEVEPKPLPDIIDQVVGQPQPKTSQQPLQPIQPPQNLSVQQPPKQQSQEKPPQTLFPSIVKNMPTKPNGTLSHKSGRRRWGQTIFKSGDSWEELEDYDFGASHSKKPSMGVFKEKRKKDSPFRQQVKMAVISLSAHQFPTL

SEQ ID NO: 52473 - protein, 292 aa, Homo sapiens
MLGAWAVEGTAVALLRLLLLLLPPAIRGPGLGVAGVAGAAGAGLPESVIWAVNAGGEAHVDVHGIHFRKDPLEGRVGRASDYGMKLPILRSNPEDQILYQTERYNEETFGYEVPIKEEGDYVLVLKFAEVYFAQSQQKVFDVRLNGHVVVKDLDIFDRVGHSTAHDEIIPMSIRKGKLSVQGEVSTFTGKLYIEFVKGYYDNPKVCALYIMAGTVDDVPKLQPHPGLEKKEEEEEEEEYDEGSNLKKQTNKNRVQSGPRTPNPYASDNSSLMFPILVAFGVFIPTLFCLCRL

SEQ ID NO: 52474 - protein, 185 aa, Homo sapiens
MGPERHLSGAPARMATVVLGGDTMGPERIFPNQTEELGHQGPSEGTGDWSSEEPEEEQEETGSGPAGYSYQPLNQDPEQEEVELAPVGDGDVVADIQDRIQALGLHLPDPPLESEDEDEEGATALNNHSSIPMDPEHVELVKRTMAGVSLPAPGVPAWAREISDAQWEDVVQKALQARQASPAWK

SEQ ID NO: 52475 - protein, 572 aa, Homo sapiens
MEPEAPRRRHTHQRGYLLTRNPHLNKDLAFTLEERQQLNIHGLLPPSFNSQEIQVLRVVKNFEHLNSDFDRYLLLMDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 52476 - protein, 232 aa, Homo sapiens
VKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 52477 - protein, 406 aa, Homo sapiens [sequence omitted]

SEQ ID NO: 52478 - protein, 497 aa, Homo sapiens
MDLQDRNEKLFYRVLTSDIEKFMPIVYTPTVGLACQQYSLVFRKPRGLFITIHDRGHIASVLNAWPEDVIKAIVVTDGERILGLGDLGCNGMGIPVGKLALYTACGGMNPQECLPVILDVGTENEELLKDPLYIGLRQRRVRGSEYDDFLDEFMEAVSSKYGMNCLIQFEDFANVNAFRLLNKYRNQYCTFNDDIQGTASVAVAGLLAALRITKNKLSDQTILFQGAGEAALGIAHLIVMALEKEGLPKEKAIKKIWLVDSKGLIVKGRASLTQEKEKFAHEHEEMKNLEAIVQEIKPTALIGVAAIGGAFSEQILKDMAAFNERPIIFALSNPTSKAECSAEQCYKITKGRAIFASGSPFDPVTLPNGQTLYPGQGNNSYVFPGVALGVVACGLRQITDNIFLTTAEVIAQQVSDKHLEEGRLYPPLNTIRDVSLKIAEKIVKDAYQEKTATVYPEPQNKEAFVRSQMYSTDYDQILPDCYSWPEEVQKIQTKVDQ

SEQ ID NO: 52479 - protein, 584 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGVALAVILCNTRHISDSVFLEAAKALTSQLTDEELAQGRLYPPLANIQEVSINIAIKVTEYLYANKMAFRYPEPEDKAKYVKERTWRSEYDSLLPDVYEWPESASSPPVITE

SEQ ID NO: 52480 - protein, 479 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGYRIPIC

SEQ ID NO: 52481 - protein, 259 aa, Homo sapiens
MAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQDDFSRGPKRSQLFFK

SEQ ID NO: 52482 - protein, 604 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 52483 - protein, 604 aa, Homo sapiens; identical to SEQ ID NO: 52482

SEQ ID NO: 52484 - protein, 581 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITKNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYT

SEQ ID NO: 52485 - protein, 342 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTTCHTFSCPWHLWAQVMFQHIPGPMGFSEWLPRNS

SEQ ID NO: 52486 - protein, 62 aa, Homo sapiens
MGAALGTGTRLAPWPGRACGALPRWTPTAPAQGCHSKPGPARPVPLKKRGYDVTRNPHLNKV

SEQ ID NO: 52487 - protein, 61 aa, Homo sapiens
MGAALGTGTRLAPWPGRACGALPRWTPTAPAQGCHSKPGPARPVPLKKRGYDVTRNPHLNK

SEQ ID NO: 52488 - protein, 151 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLT

SEQ ID NO: 52489 - protein, 79 aa, Homo sapiens
MGAALGTGTRLAPWPGRACGALPRWTPTAPAQGCHSKPGPARPVPLKKRGYDVTRNPHLNKVMGQRAGRPALRSRGCRK

SEQ ID NO: 52490 - protein, 604 aa, Homo sapiens; identical to SEQ ID NO: 52482

SEQ ID NO: 52491 - protein, 252 aa, Homo sapiens
MAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQAPSTAPAT

SEQ ID NO: 52492 - protein, 493 aa, Homo sapiens
MRGFGPGLTARRLLPLRLPPRPPGPRLASGQAAGALERAMDELLRRAVPPTPAYELREKTPAPAEGQCADFVSFYGGLAETAQRAELLGRLARGFGVDHGQVAEQSAGVLHLRQQQREAAVLLQAEDRLRYALVPRYRGLFHHISKLDGGVRFLVQLRADLLEAQALKLVEGPDVREMNGVLKGMLSEWFSSGFLNLERVTWHSPCEVLQKISEAEAVHPVKNWMDMKRRVGPYRRCYFFSHCSTPGEPLVVLHVALTGDISSNIQAIVKEHPPSETEEKNKITAAIFYSISLTQQGLQGVELGTFLIKRVVKELQREFPHLGVFSSLSPIPGFTKWLLGLLNSQTKEHGRNELFTDSECKEISEITGGPINETLKLLLSSSEWVQSEKLVRALQTPLMRLCAWYLYGEKHRGYALNPVANFHLQNGAVLWRINWMADVSLRGITGSCGLMANYRYFLEETGPNSTSYLGSKIIKASEQVLSLVAQFQKNSKL

SEQ ID NO: 52493 - protein, 185 aa, Homo sapiens
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHF

SEQ ID NO: 52494 - protein, 1662 aa, Homo sapiens
AVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDAAFVNISRNVLQTRYTLLPYLYTLMQKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRKNPLGLIIALDENKEAKGELFWDDGQTKDTVAKKVYLLCEFSVTQQVVFLNIVFN

SEQ ID NO: 52495 - protein, 1857 aa, Homo sapiens
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLSTRLPSTNVYGLGEHVHQQYRHDMNWKTWPIFNRDTTPNGNGTNLYGAQTFFLCLEDASGLSFGVFLMNSNAMEVVLQPAPAITYRTIGGILDFYVFLGNTPEQVVQEYLELIGRPALPSYWALGFHLSRYEYGTLDNMREVVERNRAAQLPYDVQHADIDYMDERRDFTYDSVDFKGFPEFVNELHNNGQKLVIIVDPAISNNSSSSKPYGPYDRGSDMKIWVNSSDGVTPLIGEVWPGQTVFPDYTNPNCAVWWTKEFELFHNQVEFDGIWIDMNEVSNFVDGSVSGCSTNNLNNPPFTPRILDGYLFCKTLCMDAVQHWGKQYDIHNLYGYSMAVATAEAAKTVFPNKRSFILTRSTFAGSGKFAAHWLGDNTATWDDLRWSIPGVLEFNLFGIPMVGPDICGFALDTPEELCRRWMQLGAFYPFSRNHNGQGYKDQDPASFGADSLLLNSSRHYLNIRYTLLPYLYTLFFRAHSRGDTVARPLLHEFYEDNSTWDVHQQFLWGPGLLITPVLDEGAEKVMAYVPDAVWYDYETGSQVRWRKQKVEMELPGDKIGLHLRGGYIFPTQQPNTTTLASRKNPLGLIIALDENKEAKGELFWDNGETKDTVANKVYLLCEFSVTQNRLEVNISQSTYKDPNNLAFNEIKILGTEEPSNVTVKHNGVPSQTSPTVTYDSNLKVAIITDIDLLLGEAYTVEWSIKIRDEEKIDCYPDENGASAENCTARGCIWEASNSSGVPFCYFVNDLYSVSDVQYNSHGATADISLKSSVYANAFPSTPVNPLRLDVTYHKNEMLQFKIYDPNKNRYEVPVPLNIPSMPSSTPEGQLYDVLIKKNPFGIEIRRKSTGTIIWDSQLLGFTFSDMFIRISTRLPSKYLYGFGETEHRSYRRDLEWHTWGMFSRDQPPGYKKNSYGVHPYYMGLEEDGSAHGVLLLNSNAMDVTFQPLPALTYRTTGGVLDFYVFLGPTPELVTQQYTELIGRPVMVPYWSLGFQLCRYGYQNDSEIASLYDEMVAAQIPYDVQYSDIDYMERQLDFTLSPKFAGFPALINRMKADGMRVILILDPAISGNETQPYPAFTRGVEDDVFIKYPNDGDIVWGKVWPDFPDVVVNGSLDWDSQVELYRAYVAFPDFFRNSTAKWWKREIEELYNNPQNPERSLKFDGMWIDMNEPSSFVNGAVSPGCRDASLNHPPYMPHLESRDRGLSSKTLCMESQQILPDGSLVQHYNVHNLYGWSQTRPTYEAVQEVTGQRGVVITRSTFPSSGRWAGHWLGDNTAAWDQLKKSIIGMMEFSLFGISYTGADICGFFQDAEYEMCVRWMQLGAFYPFSRNHNTIGTRRQDPVSWDVAFVNISRTVLQTRYTLLPYLYTLMHKAHTEGVTVVRPLLHEFVSDQVTWDIDSQFLLGPAFLVSPVLERNARNVTAYFPRARWYDYYTGVDINARGEWKTLPAPLDHINLHVRGGYILPWQEPALNTHLSRQKFMGFKIALDDEGTAGGWLFWDDGQSIDTYGKGLYYLASFSASQNTMQSHIIFNNYITGTNPLKLGYIEIWGVGSVPVTSVSISVSGMVITPSFNNDPTTQVLSIDVTDRNISLHNFTSLTWISTL

SEQ ID NO: 52496 - protein, 686 aa, Homo sapiens
MLLRGVLLALQALQLAGALDLPAGSCAFEESTCGFDSVLASLPWILNEEGHYIYVDTSFGKQGEKAVLLSPDLQAEEWSCLRLVYQITTSSESLSDPSQLNLYMRFEDESFDRLLWSAKEPSDSWLIASLDLQNSSKKFKILIEGVLGQGNTASIALFEIKMTTGYCIECDFEENHLCGFVNRWNPNVNWFVGGGSIRNVHSILPQDHTFKSELGHYMYVDSVYVKHFQEVAQLISPLTTAPMAGCLSFYYQIQQGNDNVFSLYTRDVAGLYEEIWKADRPGNAAWNLAEVEFSAPYPMEVIFEVAFNGPKGGYVALDDISFSPVHCQNQTELLFSAVEASCNFEQDLCNFYQDKEGPGWTRVKVKPNMYRAGDHTTGLGYYLLANTKFTSQPGYIGRLYGPSLPGNLQYCLRFHYAIYGFLKMSDTLAVYIFEENHVVQEKIWSVLESPRGVWMQAEITFKKPMPTKVVFMSLCKSFWDCGLVALDDITIQLGSCSSSEKLPPPPGECTFEQDECTFTQEKRNRSSWHRRRGETPTSYTGPKGDHTTGVGYYMYIEASHMVYGQKARLLSRPLRGVSGKHCLTFFYHMYGGGTGLLSVYLKKEEDSEESLLWRRRGEQSISWLRALIEYSCERQHQIIFEAIRGVSIRSDIAIDDVKFQAGPCGEMEDTTQQSSGYSEDLNEIEY

SEQ ID NO: 52497 - protein, 959 aa, Homo sapiens
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQSPCFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTELLALRTLSSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKVVVMPGSGAPCQSSPQLWGPMAIFLLALQR

SEQ ID NO: 52498 - protein, 955 aa, Homo sapiens
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKVVVMPGSGAPCQSSPQLWGPMAIFLLALQR

SEQ ID NO: 52499 - protein, 973 aa, Homo sapiens
MEVTCLLLLALIPFHCRGQGVYAPAQAQIVHAGQACVVKEDNISERVYTIREGDTLMLQCLVTGHPRPQVRWTKTAGSASDKFQETSVFNETLRIERIARTQGGRYYCKAENGVGVPAIKSIRVDVQYLDEPMLTVHQTVSDVRGNFYQEKTVFLRCTVNSNPPARFIWKRGSDTLSHSQDNGVDIYEPLYTQGETKVLKLKNLRPQDYASYTCQVSVRNVCGIPDKAITFRLTNTTAPPALKLSVNETLVVNPGENVTVQCLLTGGDPLPQLQWSHGPGPLPLGALAQGGTLSIPSVQARDSGYYNCTATNNVGNPAKKTVNLLVRSMKNATFQITPDVIKESENIQLGQDLKLSCHVDAVPQEKVTYQWFKNGKPARMSKRLLVTRNDPELPAVTSSLELIDLHFSDYGTYLCMASFPGAPVPDLSVEVNISSETVPPTISVPKGRAVVTVREGSPAELQCEVRGKPRPPVLWSRVDKEAALLPSGLPLEETPDGKLRLERVSRDMSGTYRCQTARYNGFNVRPREAQVQLNVQFPPEVEPSSQDVRQALGRPVLLRCSLLRGSPQRIASAVWRFKGQLLPPPPVVPAAAEAPDHAELRLDAVTRDSSGSYECSVSNDVGSAACLFQVSAKAYSPEFYFDTPNPTRSHKLSKNYSYVLQWTQREPDAVDPVLNYRLSIRQLNQHNAVVKAIPVRRVEKGQLLEYILTDLRVPHSYEVRLTPYTTFGAGDMASRIIHYTEPINSPNLSDNTCHFEDEKICGYTQDLTDNFDWTRQNALTQNPKRSPNTGPPTDISGTPEGYYMFIETSRPRELGDRARLVSPLYNASAKFYCVSFFYHMYGKHIGSLNLLVRSRNKGALDTHAWSLSGNKGNVWQQAHVPISPSGPFQIIFEGVRGPGYLGDIAIDDVTLKKGECPRKQTDPNKGARREGGGGAESGGSCAWRGFLSVEGGCLGLNRGSECLSDGNHVALTV

SEQ ID NO: 52500 - protein, 727 aa, Homo sapiens
MVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 52501 - protein, 158 aa, Homo sapiens
MYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 52502 - protein, 1025 aa, Homo sapiens
MSVWSAGLLRSARRRRRGRTDGRRFLLRRAVPGHLGLARARVERAWLAAGLLKVPLRTPWAGYVHVHVKMDLLYGLVWLLTVLLEGISGQGVYAPPTVRIVHSGLACNIEEERYSERVYTIREGETLELTCLVTGHPRPQIRWTKTAGSASDRFQDSSVFNETLRITNIQRHQGGRYYCKAENGLGSPAIKSIRVDVYYLDDPVVTVHQSIGEAKEQFYYERTVFLRCVANSNPPVRYSWRRGQEVLLQGSDKGVEIYEPFFTQGETKILKLKNLRPQDYANYSCIASVRNVCNIPDKMVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 52503 - protein, 727 aa, Homo sapiens; identical to SEQ ID NO: 52500

SEQ ID NO: 52504 - protein, 956 aa, Homo sapiens
MDLLYGLVWLLTVLLEGISGQGVYAPPTVRIVHSGLACNIEEERYSERVYTIREGETLELTCLVTGHPRPQIRWTKTAGSASDRFQDSSVFNETLRITNIQRHQGGRYYCKAENGLGSPAIKSIRVDVYYLDDPVVTVHQSIGEAKEQFYYERTVFLRCVANSNPPVRYSWRRGQEVLLQGSDKGVEIYEPFFTQGETKILKLKNLRPQDYANYSCIASVRNVCNIPDKMVSFRLSNKTASPSIKLLVDDPIVVNPGEAITLVCVTTGGEPAPSLTWVRSFGTLPEKTVLNGGTLTIPAITSDDAGTYSCIANNNVGNPAKKSTNIIVRALKKGRFWITPDPYHKDDNIQIGREVKISCQVEAVPSEELTFSWFKNGRPLRSSERMVITQTDPDVSPGTTNLDIIDLKFTDFGTYTCVASLKGGGISDISIDVNISSSTVPPNLTVPQEKSPLVTREGDTIELQCQVTGKPKPIILWSRADKEVAMPDGSMQMESYDGTLRIVNVSREMSGMYRCQTSQYNGFNVKPREALVQLIVQYPPAVEPAFLEIRQGQDRSVTMSCRVLRAYPIRVLTYEWRLGNKLLRTGQFDSQEYTEYAVKSLSNENYGVYNCSIINEAGAGRCSFLVTGKAYAPEFYYDTYNPVWQNRHRVYSYSLQWTQMNPDAVDRIVAYRLGIRQAGQQRWWEQEIKINGNIQKGELITYNLTELIKPEAYEVRLTPLTKFGEGDSTIRVIKYSAPVNPHLREFHCGFEDGNICLFTQDDTDNFDWTKQSTATRNTKYTPNTGPNADRSGSKEGFYMYIETSRPRLEGEKARLLSPVFSIAPKNPYGPTNTAYCFSFFYHMYGQHIGVLNVYLRLKGQTTIENPLWSSSGNKGQRWNEAHVNIYPITSFQLIFEGIRGPGIEGDIAIDDVSIAEGECAKQDLATKNSVDGAVGILVHIWLFPIIVLISILSPRR

SEQ ID NO: 52505 - protein, 380 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKKNEIDLESELKSEQVTE

SEQ ID NO: 52506 - protein, 728 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 52507 - protein, 699 aa, Homo sapiens
MRWLLLYYALCFSLSKASAHTVELNNMFGQIQSPGYPDSYPSDSEVTWNITVPDGFRIKLYFMHFNLESSYLCEYDYVKVETEDQVLATFCGRETTDTEQTPGQEVVLSPGSFMSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPVCGLPKFSRKLMARIFNGRPAQKGTTPWIAMLSHLNGQPFCGGSLLGSSWIVTAAHCLHQSLDPEDPTLRDSDLLSPSDFKIILGKHWRLRSDENEQHLGVKHTTLHPQYDPNTFENDVALVELLESPVLNAFVMPICLPEGPQQEGAMVIVSGWGKQFLQRFPETLMEIEIPIVDHSTCQKAYAPLKKKVTRDMICAGEKEGGKDACAGDSGGPMVTLNRERGQWYLVGTVSWGDDCGKKDRYGVYSYIHHNKDWIQRVTGVRN

SEQ ID NO: 52508 - protein, 615 aa, Homo sapiens
MSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPEGPAPHMLGLVAGWGISNPNVTVDEIISSGTRTLSDVLQYVKLPVVPHAECKTSYESRSGNYSVTENMFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 52509 - protein, 82 aa, Homo sapiens
MFCAGYYEGGKDTCLGDSGGAFVIFDDLSQRWVVQGLVSWGGPEECGSKQVYGVYTKVSNYVDWVWEQMGLPQSVVEPQVER

SEQ ID NO: 52510 - protein, 480 aa, Homo sapiens
MSITFRSDFSNEERFTGFDAHYMAVDVDECKEREDEELSCDHYCHNYIGGYYCSCRFGYILHTDNRTCRVECSDNLFTQRTGVITSPDFPNPYPKSSECLYTIELEEGFMVNLQFEDIFDIEDHPEVPCPYDYIKIKVGPKVLGPFCGEKAPEPISTQSHSVLILFHSDNSGENRGWRLSYRAAGNECPELQPPVHGKIEPSQAKYFFKDQVLVSCDTGYKVLKDNVEMDTFQIECLKDGTWSNKIPTCKIVDCRAPGELEHGLITFSTRNNLTTYKSEIKYSCQEPYYKMLNNNTGIYTCSAQGVWMNKVLGRSLPTCLPECGQPSRSLPSLVKRIIGGRNAEPGLFPWQALIVVEDTSRVPNDKWFGSGALLSASWILTAAHVLRSQRRDTTVIPVSKEHVTVYLGLHDVRDKSGAVNSSAARVVLHPDFNIQNYNHDIALVQLQEPVPLGPHVMPVCLPRLEPPGGRLGHLQSQCDS

SEQ ID NO: 52511 - protein, 686 aa, Homo sapiens
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSALCSGQVFTQRSGELSSPEYPRPYPKLSSCTYSISLEEGFSVILDFVESFDVETHPETLCPYDFLKIQTDREEHGPFCGKTLPHRIETKSNTVTITFVTDESGDHTGWKIHYTSTAQPCPYPMAPPNGHVSPVQAKYILKDSFSIFCETGYELLQGHLPLKSFTAVCQKDGSWDRPMPACSIVDCGPPDDLPSGRVEYITGPGVTTYKAVIQYSCEETFYTMKVNDGKYVCEADGFWTSSKGEKSLPVCEPVCGLSARTTGGRIYGGQKAKPGDFPWQVLILGGTTAAGALLYDNWVLTAAHAVYEQKHDASALDIRMGTLKRLSPHYTQAWSEAVFIHEGYTHDAGFDNDIALIKLNNKVVINSNITPICLPRKEAESFMRTDDIGTASGWGLTQRGFLARNLMYVDIPIVDHQKCTAAYEKPPYPRGSVTANMLCAGLESGGKDSCRGDSGGALVFLDSETERWFVGGIVSWGSMNCGEAGQYGVYTKVINYIPWIENIISDF

SEQ ID NO: 52512 - protein, 185 aa, Homo sapiens
MRLLTLLGLLCGSVATPLGPKWPEPVFGRLASPGFPGEYANDQERRWTLTAPPGYRLRLYFTHFDLELSHLCEYDFVKLSSGAKVLATLCGQESTDTERAPGKDTFYSLGSSLDITFRSDYSNEKPFTGFEAFYAAEDIDECQVAPGEAPTCDHHCHNHLGGFYCSCRAGYVLHRNKRTCSEQSL

SEQ ID NO: 52513 - protein, 362 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKTAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 52514 - protein, 423 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 52515 - protein, 267 aa, Homo sapiens
MGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGGPWLCH

SEQ ID NO: 52516 - protein, 373 aa, Homo sapiens
MGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIYFLNLLTLKPGEAMFLEANVPHAYLKGDCVECMACSDNTVRAGLTPKFIDVPTLCEMLSYTPSSSKDRLFLPTRSQEDPYLSIYDPPVPDFTIMKTEVPGSVTEYKVLALDSASILLMVQGTVIASTPTTQTPIPLQRGGVLFIGANESVSLKLTEPKDLLIFRACCLL

SEQ ID NO: 52517 - protein, 1456 aa, Homo sapiens [sequence omitted]

SEQ ID NO: 52518 - protein, 1479 aa, Homo sapiens
MGPGRPAPAPWPRHLLRCVLLLGCLHLGRPGAPGDAALPEPNVFLIFSHGLQGCLEAQGGQVRVTPACNTSLPAQRWKWVSRNRLFNLGTMQCLGTGWPGTNTTASLGMYECDREALNLRWHCRTLGDQLSLLLGARTSNISKPGTLERGDQTRSGQWRIYGSEEDLCALPYHEVYTIQGNSHGKPCTIPFKYDNQWFHGCTSTGREDGHLWCATTQDYGKDERWGFCPIKSNDCETFWDKDQLTDSCYQFNFQSTLSWREAWASCEQQGADLLSITEIHEQTYINGLLTGYSSTLWIGLNDLDTSGGWQWSDNSPLKYLNWESDQPDNPSEENCGVIRTESSGGWQNRDCSIALPYVCKKKPNATAEPTPPDRWANVKVECEPSWQPFQGHCYRLQAEKRSWQESKKACLRGGGDLVSIHSMAELEFITKQIKQEVEELWIGLNDLKLQMNFEWSDGSLVSFTHWHPFEPNNFRDSLEDCVTIWGPEGRWNDSPCNQSLPSICKKAGQLSQGAAEEDHGCRKGWTWHSPSCYWLGEDQVTYSEARRLCTDHGSQLVTITNRFEQAFVSSLIYNWEGEYFWTALQDLNSTGSFFWLSGDEVMYTHWNRDQPGYSRGGCVALATGSAMGLWEVKNCTSFRARYICRQSLGTPVTPELPGPDPTPSLTGSCPQGWASDTKLRYCYKVFSSERLQDKKSWVQAQGACQELGAQLLSLASYEEEHFVANMLNKIFGESEPEIHEQHWFWIGLNRRDPRGGQSWRWSDGVGFSYHNFDRSRHDDDDIRGCAVLDLASLQWVAMQCDTQLDWICKIPRGTDVREPDDSPQGRREWLRFQEAEYKFFEHHSTWAQAQRICTWFQAELTSVHSQAELDFLSHNLQKFSRAQEQHWWIGLHTSESDGRFRWTDGSIINFISWAPGKPRPVGKDKKCVYMTASREDWGDQRCLTALPYICKRSNVTKETQPPDLPTTALGGCPSDWIQFLNKCFQVQGQEPQSRVKWSEAQFSCEQQEAQLVTITNPLEQAFITASLPNVTFDLWIGLHASQRDFQWVEQEPLMYANWAPGEPSGPSPAPSGNKPTSCAVVLHSPSAHFTGRWDDRSCTEETHGFICQKGTDPSLSPSPAALPPAPGTELSYLNGTFRLLQKPLRWHDALLLCESRNASLAYVPDPYTQAFLTQAARGLRTPLWIGLAGEEGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 52519 - protein, 345 aa, Homo sapiens
MPTGHLGSPLALALLPVATNRPAVQWSCTAPQPTSLAAGTIGAARRRPMASSARRARGSRRYSWVSEEPLNYVGWQDGEPQQPGGCTYVDVDGAWRTTSCDTKLQGAVCGVSSGPPPPRRISYHGSCPQGLADSAWIPFREHCYSFHMELLLGHKEARQRCQRAGGAVLSILDEMENVFVWEHLQSYEGQSRGAWLGMNFNPKGGTLVWQDNTAVNYSNWGPPGLGPSMLSHNSCYWIQSNSGLWRPGACTNITMGVVCKLPRAEQSSFSPSALPENPAALVVVLMAVLLLLALLTAALILYRRRQSIERGAFEGARYSRSSSSPTEATEKNILVSDMEMNEQQE

SEQ ID NO: 52520 - protein, 277 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNETHIFNGSNWIMLIYKGGDEYDNHCGKEQRRAVVMISCNRHTLADNFNPVSEERGKVQDCFYLFEMDSSLACSPEISHLSVGSILLVTFASLVAVYVVGGFLYQRLVVGAKGMEQFPHLAFWQDLGNLVADGCDFVCRSKPRNVPAAYRGVGDDQLGEESEERDDHLLPM

SEQ ID NO: 52521 - protein, 92 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQ

SEQ ID NO: 52522 - protein, 109 aa, Homo sapiens
MFPFYSCWRTGLLLLLLAVAVRESWQTEEKTCDLVGEKGKESEKELALVKRLKPLFNKSFESTVGQGSDTYIYIFRVCREAGNHTSGAGLVQINKSNGKETVVGRLNET

SEQ ID NO: 52523 - protein, 248 aa, Homo sapiens
MSLFPSLPLLLLSMVAASYSETVTCEDAQKTCPAVIACSSPGINGFPGKDGRDGTKGEKGEPGQGLRGLQGPPGKLGPPGNPGPSGSPGPKGQKGDPGKSPDGDSSLAASERKALQTEMARIKKWLTFSLGKQVGNKFFLTNGEIMTFEKVKALCVKFQASVATPRNAAENGAIQNLIKEEAFLGITDEKTEGQFVDLTGNRLTYTNWNEGEPNNAGSDEDCVLLLKNGQWNDVPCSTSHLAVCEFPI

SEQ ID NO: 52524 - protein, 247 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNYHNGHTGQLSAITVFLLFGGSLARIFTSIQETGDPLMAGTFVVSSLCNGLIAAQLLFYWNAKPPHKQKKAQ

SEQ ID NO: 52525 - protein, 126 aa, Homo sapiens
MAAEADGPLKRLLVPILLPEKCYDQLFVQWDLLHVPCLKILLSKGLGLGIVAGSLLVKLPQVFKILGAKSAAGLKKEDEARPVRSASMRVRGGLGAWGHQQGEGCMEWESQGAGSGYRWAAVPPGA

SEQ ID NO: 52526 - protein, 299 aa, Homo sapiens [sequence omitted]

SEQ ID NO: 52527 - protein, 211 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFSSWGEALFLMLQTITICFLVMHYRGQTVKGVAFLACYGLVLLVLLSPLTPLTVVTLLQASNVPAVVVGRLLQAATNTTTGTQASSQPSQSSCCLGAPWPESSLPFRKPEIP

SEQ ID NO: 52528 - protein, 186 aa, Homo sapiens
MAAEADGPLKRLLVPILLPEKCYDQLFVQWDLLHVPCLKILLSKGLGLGIVAGSLLVKLPQVFKILGAKSAEGLSLQSVMLELVALTGTMVYSITNNFPFRCRFPRLLRPGPAGASLTSDALDCSHPAPGLQCACCGGGEASPGSHQLPQRAHRPALSHHSLPAVWGLPGPNLHFHSGVSIPFSQL

SEQ ID NO: 52529 - protein, 941 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 52530 - protein, 1057 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLGLTPSPGDSAQHGLCSCSSPHLTAAPAAPAACVRSARAPTDSASRPPPTKTDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 52531 - protein, 1017 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 52532 - protein, 367 aa, Homo sapiens
MPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEEIEARKGQANCPGSSSSCEVEIQMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKRWMCNIPRAMEATI

SEQ ID NO: 52533 - protein, 653 aa, Homo sapiens
MPVGGLLPLFSSPAGGVLGGGLGGGGGRKGSGPAALRLTEKFVLLLVFSAFITLCFGAIFFLPDSSKLLSGVLFHSSPALQPAADHKPGPGARAEDAAEGRARRREEGAPGDPEAALEDNLARIRENHERALREAKETLQKLPEEIQRDILLEKKKVAQDQLRDKAPFRGLPPVDFVPPIGVESREPADAAIREKRAKIKEMMKHAWNNYKGYAWGLNELKPISKGGHSSSLFGNIKGATIVDALDTLFIMEMKHEFEEAKSWVEENLDFNVNAEISVFEVNIRFVGGLLSAYYLSGEEIFRKKAVELGVKLLPAFHTPSGIPWALLNMKSGIGRNWPWASGGSSILAEFGTLHLEFMHLSHLSGNPIFAEKVMNIRTVLNKLEKPQGLYPNYLNPSSGQWGQHHVSVGGLGDSFYEYLLKAWLMSDKTDLEAKKMYFDAVQAIETHLIRKSSSGLTYIAEWKGGLLEHKMGHLTCFAGGMFALGADAAPEGMAQHYLELGAEIARTCHESYNRTFMKLGPEAFRFDGGVEAIATRQNEKYYILRPEVMETYMYMWRLTHDPKYRKWAWEAVEALENHCRVNGGYSGLRDVYLLHESYDDVQQSFFLAETLKYLYLIFSDDDLLPLEHWIFNSEAHLLPILPKDKKEVEIREE

SEQ ID NO: 52534 - protein, 192 aa, Homo sapiens
MFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGTSQGMRRQNPYFQVLYLYYPDD

SEQ ID NO: 52535 - protein, 641 aa, Homo sapiens
MTTPALLPLSGRRIPPLNLGPPSFPHHRATLRLSEKFILLLILSAFITLCFGAFFFLPDSSKHKRFDLGLEDVLIPHVDAGKGAKNPGVFLIHGPDEHRHREEEERLRNKIRADHEKALEEAKEKLRKSREEIRAEIQTEKNKVVQEMKIKENKPLPPVPIPNLVGIRGGDPEDNDIREKREKIKEMMKHAWDNYRTYGWGHNELRPIARKGHSPNIFGSSQMGATIVDALDTLYIMGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSGNPAVR

SEQ ID NO: 52536 - protein, 375 aa, Homo sapiens
MGLHDEFLDGQRWIEDNLDFSVNSEVSVFEVNIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKLASYHERTVFPAG

SEQ ID NO: 52537 - protein, 204 aa, Homo sapiens
  MOD_RES (1)..(1): Any amino acid
XIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKYLYLLFSGDDLLPLDHWVFNTEAHPLPVLHLANTTLSES

SEQ ID NO: 52538 - protein, 97 aa, Homo sapiens
EKYCRVNGGFSGVKDVYSSTPTHDDVQQSFFLAETLKYLYLLFSGDDLLPLDHWVFNTEAHPLPVLHLANTTLSGTSQGMRRQNPYFQVLYLYYPDD

SEQ ID NO: 52539 - protein, 344 aa, Homo sapiens
  MOD_RES (1)..(1): Any amino acid
XIRFIGGLLAAYYLSGEEIFKIKAVQLAEKLLPAFNTPTGIPWAMVNLKSGVGRNWGWASAGSSILAEFGTLHMEFIHLSYLTGDLTYYKKVMHIRKLLQKMDRPNGLYPNYLNPRTGRWGQYHTSVGGLGDSFYEYLLKAWLMSDKTDHEARKMYDDAIEAIEKHLIKKSRGGLTFIGEWKNGHLEKKMGHLACFAGGMFALGADGSRADKAGHYLELGAEIARTCHESYDRTALKLGPESFKFDGAVEAVAVRQAEKYYILRPEVIETYWYLWRFTHDPRYRQWGWEAALAIEKYCRVNGGFSGVKDVYSSTPTHDDVQQSFFLAETLKLASYHERTVFPAG

SEQ ID NO: 52540 - protein, 699 aa, Homo sapiens
MAACEGRRSGALGSSQSDFLTPPVGGAPWAVATTVVMYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 52541 - protein, 402 aa, Homo sapiens
MWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVPSGGYSSINNVQDPQKPEPRDKMESFFLGETLKYLFLLFSDDPNLLSLDAYVFNTEAHPLPIWTPA

SEQ ID NO: 52542 - protein, 705 aa, Homo sapiens
  MOD_RES (1)..(1): Any amino acid
XPWAVATTVVMYPPPPPPPHRDFISVTLSFGENYDNSKSWRRRSCWRKWKQLSRLQRNMILFLLAFLLFCGLLFYINLADHWKALAFRLEEEQKMRPEIAGLKPANPPVLPAPQKADTDPENLPEISSQKTQRHIQRGPPHLQIRPPSQDLKDGTQEEATKRQEAPVDPRPEGDPQRTVISWRGAVIEPEQGTELPSRRAEVPTKPPLPPARTQGTPVHLNYRQKGVIDVFLHAWKGYRKFAWGHDELKPVSRSFSEWFGLGLTLIDALDTMWILGLRKEFEEARKWVSKKLHFEKDVDVNLFESTIRILGGLLSAYHLSGDSLFLRKAEDFGNRLMPAFRTPSKIPYSDVNIGTGVAHPPRWTSDSTVAEVTSIQLEFRELSRLTGDKKFQEAVEKVTQHIHGLSGKKDGLVPMFINTHSGLFTHLGVFTLGARADSYYEYLLKQWIQGGKQETQLLEDYVEAIEGVRTHLLRHSEPSKLTFVGELAHGRFSAKMDHLVCFLPGTLALGVYHGLPASHMELAQELMETCYQMNRQMETGLSPEIVHFNLYPQPGRRDVEVKPADRHNLLRPETVESLFYLYRVTGDRKYQDWGWEILQSFSRFTRVSTCPRPAWSRPPGHRHGWAVGLRLAPLLVVAVTWIREGRACRSLGVATLQLGGPGIPIPTELHGCGTQSTWRGWAPLIFISQGLSREGLCCGPSIPPV

SEQ ID NO: 52543 - protein, 1144 aa, Homo sapiens
MKLSRQFTVFGSAIFCVVIFSLYLMLDRGHLDYPRNPRREGSFPQGQLSMLQEKIDHLERLLAENNEIISNIRDSVINLSESVEDGPKSSQSNFSQGAGSHLLPSQLSLSVDTADCLFASQSGSHNSDVQMLDVYSLISFDNPDGGVWKQGFDITYESNEWDTEPLQVFVVPHSHNDPGWLKTFNDYFRDKTQYIFNNMVLKLKEDSRRKFIWSEISYLSKWWDIIDIQKKDAVKSLIENGQLEIVTGGWVMPDEATPHYFALIDQLIEGHQWLENNIGVKPRSGWAIDPFGHSPTMAYLLNRAGLSHMLIQRVHYAVKKHFALHKTLEFFWRQNWDLGSVTDILCHMMPFYSYDIPHTCGPDPKICCQFDFKRLPGGRFGCPWGVPPETIHPGNVQSRARMLLDQYRKKSKLFRTKVLLAPLGDDFRYCEYTEWDLQFKNYQQLFDYMNSQSKFKVKIQFGTLSDFFDALDKADETQRDKGQSMFPVLSGDFFTYADRDDHYWSGYFTSRPFYKRMDRIMESHLRAAEILYYFALRQAHKYKINKFLSSSLYTALTEARRNLGLFQHHDAITGTAKDWVVVDYGTRLFHSLMVLEKIIGNSAFLLILKDKLTYDSYSPDTFLEMDLKQKSQDSLPQKNIIRLSAEPRYLVVYNPLEQDRISLVSVYVSSPTVQVFSASGKPVEVQVSAVWDTANTISETAYEISFRAHIPPLGLKVYKILESASSNSHLADYVLYKNKVEDSGIFTIKNMINTEEGITLENSFVLLRFDQTGLMKQMMTKEDGKHHEVNVQFSWYGTTIKRDKSGAYLFLPDGNAKPYVYTTPPFVRVTHGRIYSEVTCFFDHVTHRVRLYHIQGIEGQSVEVSNIVDIRKVYNREIAMKISSDIKSQNRFYTDLNGYQIQPRMTLSKLPLQANVYPMTTMAYIQDAKHRLTLLSAQSLGVSSLNSGQIEVIMDRRLMQDDNRGLEQGIQDNKITANLFRILLEKRSAVNTEEEKKSVSYPSLLSHITSSLMNHPVIPMANKFSSPTLELQGEFSPLQSSLPCDIHLVNLRTIQSKVGNGHSNEAALILHRKGFDCRFSSKGTGLFCSTTQGKILVQKLLNKFIVESLTPSSLSLMHSPPGTQNISEINLSPMEISTFRIQLR

SEQ ID NO: 52544 - protein, 1150 aa, Homo sapiens
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 52545 - protein, 340 aa, Homo sapiens
MQVWFSGLTGLLKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 52546 - protein, 658 aa, Homo sapiens
MTSDMTSPRSGMPSSSTTNGSLTSSTAGLTSMCRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 52547 - protein, 72 aa, Homo sapiens
MKLKKQVTVCGAAIFCVAVFSLYLMLDRVQHDPTRHQNGGNFPRSQISVLQNRIEQLEQLLEENHEIISHIK

SEQ ID NO: 52548 - protein, 50 aa, Homo sapiens
MKLKKQVTVCGAAIFCVAVFSLYLMLDRVQHDPTRHQNGGNFPRSQISVL

SEQ ID NO: 52549 - protein, 1063 aa, Homo sapiens
MLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 52550 - protein, 76 aa, Homo sapiens
MKLKKQVTVCGAAIFCVAVFSLYLMLDRVQHDPTRHQNGGNFPRSQISVLQNRIEQLEQLLEENHEIISHIKDSVL

SEQ ID NO: 52551 - protein, 120 aa, Homo sapiens
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFAL

SEQ ID NO: 52552 - protein, 1040 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKGLGKDNQRSFQALYTANQMVNVCDPAQPETFPVAQALASRFFGQHGGESQHTIHATGHCHIDTAWLWPFKETVRKCARSWVTALQLMERNPEFIFACSQAQQLEWVKSRYPGLYSRIQEFACRGQFVPVGGTWVEMDGNLPSGEAMVRQFLQGQNFFLQEFGKMCSEFWLPDTFGYSAQLPQIMHGCGIRRFLTQKLSWNLVNSFPHHTFFWEGLDGSRVLVHFPPGDSYGMQGSVEEVLKTVANNRDKGRANHSAFLFGFGDGGGGPTQTMLDRLKRLSNTDGLPRVQLSSPRQLFSALESDSEQLCTWVGELFLELHNGTYTTHAQIKKGNRECERILHDVELLSSLALARSAQFLYPAAQLQHLWRLLLLNQFHDVVTGSCIQMVAEEAMCHYEDIRSHGNTLLSAAAAALCAGEPGPEGLLIVNTLPWKRIEVMALPKPGGAHSLALVTVPSMGYAPVPPPTSLQPLLPQQPVFVVQETDGSVTLDNGIIRVKLDPTGRLTSLVLVASGREAIAEGAVGNQFVLFDDVPLYWDAWDVMDYHLETRKPVLGQAGTLAVGTEGGLRGSAWFLLQISPNSRLSQEVVLDVGCPYVRFHTEVHWHEAHKFLKVEFPARVRSSQATYEIQFGHLQRPTHYNTSWDWARFEVWAHRWMDLSEHGFGLALLNDCKYGASVRGSILSLSLLRAPKAPDATADTGRHEFTYALMPHKGSFQDAGVIQAAYSLNFPLLALPAPSPAPATSWSAFSVSSPAVVLETVKQAESSPQRRSLVLRLYEAHGSHVDCWLHLSLPVQEAILCDLLERPDPAGHLTLRDNRLKLTFSPFQVLSLLLVLQPPPH

SEQ ID NO: 52553 - protein, 209 aa, Homo sapiens
MAAAPALKHWRTTLERVEKFVSPLYFTDCNLRGRLFGASCPVAVLSSFLTPERLPYQEAVQRDFRPAQVGDSFGPTWWTCWFRVELTIPEAWVGQEVHLCWESDGEGLVWRDGEPVQGLTKEGEKTSYVLTDRLGERDPRSLTLYVEVACNGLLGAGKGSMIAAPDPEKMFQLSRAELAVFHRDVHMLLVDLELLLGIAKPGFGPSKRL

SEQ ID NO: 52554 - protein, 879 aa, Homo sapiens
MRLHLLLLLALCGAGTTAAELSYSLRGNWSICNGNGSLELPGAVPGCVHSALFQQGLIQDSYYRFNDLNYRWVSLDNWTYSKEFKIPFEISKWQKVNLILEGVDTVSKILFNEVTIGETDNMFNRYSFDITNVVRDVNSIELRFQSAVLYAAQQSKAHTRYQVPPDCPPLVQKGECHVNFVRKEQCSFSWDWGPSFPTQGIWKDVRIEAYNICHLNYFTFSPIYDKSAQEWNLEIESTFDVVSSKPVGGQVIVAIPKLQTQQTYSIELQPGKRIVELFVNISKNITVETWWPHGHGNQTGYNMTVLFELDGGLNIEKSAKVYFRTVELIEEPIKGSPGLSFYFKINGFPIFLKGSNWIPADSFQDRVTSELLRLLLQSVVDANMNTLRVWGGGIYEQDEFYELCDELGIMVWQDFMFACALYPTDQGFLDSVTAEVAYQIKRLKSHPSIIIWSGNNENEEALMMNWYHISFTDRPIYIKDYVTLYVKNIRELVLAGDKSRPFITSSPTNGAETVAEAWVSQNPNSNYFGDVHFYDYISDCWNWKVFPKARFASEYGYQSWPSFSTLEKVSSTEDWSFNSKFSLHRQHHEGGNKQMLYQAGLHFKLPQSTDPLRTFKDTIYLTQVMQAQCVKTETEFYRRSRSEIVDQQGHTMGALYWQLNDIWQAPSWASLEYGGKWKMLHYFAQNFFAPLLPVGFENENTFYIYGVSDLHSDYSMTLSVRVHTWSSLEPVCSRVTERFVMKGGEAVCLYEEPVSELLRRCGNCTRESCVVSFYLSADHELLSPTNYHFLSSPKEAVGLCKAQITAIISQQGDIFVFDLETSAVAPFVWLDVGSIPGRFSDNGFLMTEKTRTILFYPWEPTSKNELEQSFHVTSLTDIY

SEQ ID NO: 52555 - protein, 462 aa, Homo sapiens
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGVLALSWYPPDVNDENGEPTDNLVPTILDKAHKYNLKVTFHIEPYSNRDDQNMYKNVKYIIDKYGNHPAFYRYKTKTGNALPMFYVYDSYITKPEKWANLLTTSGSRSIRNSPYDGLFIALLVEEKHKYDILQSGFDGIYTYFATNGFTYGSSHQNWASLKLFCDKYNLIFIPSVGPGYIDTSIRPWNTQNTRNRINGKYYEIGLSAALQTRPSLISITSFNEWHEGTQIEKAVPKRTSNTVYLDYRPHKPGLYLELTRKWSEKYSKERATYALDRQLPVS

SEQ ID NO: 52556 - protein, 198 aa, Homo sapiens
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGNYCIYIYVCLCLYICI

SEQ ID NO: 52557 - protein, 207 aa, Homo sapiens
MAKFRRRTCIILALFILFIFSLMMGLKMLRPNTATFGAPFGLDLLPELHQRTIHLGKNFDFQKSDRINSETNTKNLKSVEITMKPSKASELNLDELPPLNNYLHVFYYSWYGNPQFDGKYIHWNHPVLEHWDPRIAKNYPQGRHNPPDDIGSSFYPELGSYSSRDPSVIETHMRQMRSASIGNYCIYICVFVSVYMHINDFLCNFTS

SEQ ID NO: 52558 - protein, 792 aa, Homo sapiens
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKLQGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 52559 - protein, 445 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPLTWEGYDPSWN

SEQ ID NO: 52560 - protein, 445 aa, Homo sapiens; identical to SEQ ID NO: 52559

SEQ ID NO: 52561 - protein, 445 aa, Homo sapiens; identical to SEQ ID NO: 52559

SEQ ID NO: 52562 - protein, 445 aa, Homo sapiens; identical to SEQ ID NO: 52559

SEQ ID NO: 52563 - protein, 445 aa, Homo sapiens; identical to SEQ ID NO: 52559

SEQ ID NO: 52564 - protein, 302 aa, Homo sapiens
MLKKQSAGLVLWGAILFVAWNALLLLFFWTRPAPGRPPSVSALDGDPASLTRVFRQFRFPAAVVVEDDLEVAPDFFEYFRATYPLLKADPSLWCVSAWNDNGKEQMVDASRPELLYRTDFFPGLGWLLLAELWAELEPKWPKAFWDDWMRRPEQRQGRACIRPEISRTMTFGRKGVSHGQFFDQHLKFIKLNQQFVHFTQLDLSYLQREAYDRDFLARVYGAPQLQVEKVRTNDRKELGEVRVQYTGRDSFKAFAKALGVMDDLKSGVPRAGYRGIVTFQFRGRRVHLAPPLTWEGYDPSWN

SEQ ID NO: 52565 - protein, 103 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAP

SEQ ID NO: 52566 - protein, 199 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQ

SEQ ID NO: 52567 - protein, 111 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVI

SEQ ID NO: 52568 - protein, 154 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIAS

SEQ ID NO: 52569 - protein, 34 aa, Homo sapiens
MLKKQSAGLVLWGAILFVAWNALLLLFFWTRPAP

SEQ ID NO: 52570 - protein, 115 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDR

SEQ ID NO: 52571 - protein, 95 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQP

SEQ ID NO: 52572 - protein, 127 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLH

SEQ ID NO: 52573 - protein, 105 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAV

SEQ ID NO: 52574 - protein, 535 aa, Homo sapiens
MRLRNGTVATALAFITSFLTLSWYTTWQNGKEKLIAYQREFLALKERLRIAEHRISQRSSELNTIVQQFKRVGAETNGSKDALNKFSDNTLKLLKELTSKKSLQVPSIYYHLPHLLKNEGSLQPAVQIGNGRTGVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEIHIKKATN

SEQ ID NO: 52575 - protein, 535 aa, Homo sapiens; identical to SEQ ID NO: 52574

SEQ ID NO: 52576 - protein, 535 aa, Homo sapiens; identical to SEQ ID NO: 52574

SEQ ID NO: 52577 - protein, 423 aa, Homo sapiens
MNYSITVSIVMGIPTVKREVKSYLIETLHSLIDNLYPEEKLDCVIVVFIGETDIDYVHGVVANLEKEFSKEISSGLVEVISPPESYYPDLTNLKETFGDSKERVRWRTKQNLDYCFLMMYAQEKGIYYIQLEDDIIVKQNYFNTIKNFALQLSSEEWMILEFSQLGFIGKMFQAPDLTLIVEFIFMFYKEKPIDWLLDHILWVKVCNPEKDAKHCDRQKANLRIRFRPSLFQHVGLHSSLSGKIQKLTDKDYMKPLLLKIHVNPPAEVSTSLKVYQGHTLEKTYMGEDFFWAITPIAGDYILFKFDKPVNVESYLFHSGNQEHPGDILLNTTVEVLPFKSEGLEISKETKDKRLEDGYFRIGKFENGVAEGMVDPSLNPISAFRLSVIQNSAVWAILNEQRVFSGWWQKSRDKAEGPQAPLLF

SEQ ID NO: 52578 - protein, 548 aa, Homo sapiens
MRLRNGTFLTLLLFCLCAFLSLSWYAALSGQKGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 52579 - protein, 563 aa, Homo sapiens
MSRVAGTRTDVNELLQRWTPRCVRWHTGGARRVALDRPLVTACLPPAGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMYAQSKGIYYVQLEDDIVAKPNYLSTMKNFALQQPSEDWMILEFSQLGFIGKMFKSLDLSLIVEFILMFYRDKPIDWLLDHILWVKVCNPEKDAKHCDRQKANLRIRFKPSLFQHVGTHSSLAGKIQKLKDKDFGKQALRKEHVNPPAEVSTSLKTYQHFTLEKAYLREDFFWAFTPAAGDFIRFRFFQPLRLERFFFRSGNIEHPEDKLFNTSVEVLPFDNPQSDKEALQEGRTATLRYPRSPDGYLQIGSFYKGVAEGEVDPAFGPLEALRLSIQTDSPVWVILSEIFLKKAD

SEQ ID NO: 52580 - protein, 447 aa, Homo sapiens
MRFRIYKRKVLILTLVVAACGFVLWSSNGRQRKNEALAPPLLDAEPARGAGGRGGDHPSVAVGIRRVSNVSAASLVPAVPQPEADNLTLRYRSLVYQLNFDQTLRNVDKAGTWAPRELVLVVQVHNRPEYLRLLLDSLRKAQGIDNVLVIFSHDFWSTEINQLIAGVNFCPVLQVFFPFSIQLYPNEFPGSDPRDCPRDLPKNAALKLGCINAEYPDSFGHYREAKFSQTKHHWWWKLHFVWERVKILRDYAGLILFLEEDHYLAPDFYHVFKKMWKLKQQECPECDVLSLGTYSASRSFYGMADKVDVKTWKSTEHNMGLALTRNAYQKLIECTDTFCTYDDYNWDWTLQYLTVSCLPKFWKVLVPQIPRIFHAGDCGMHHKKTCRPSTQSAQIESLLNNNKQYMFPETLTISEKFTVVAISPPRKNGGWGDIRDHELCKSYRRLQ

SEQ ID NO: 52581 - protein, 453 aa, Homo sapiens [sequence omitted]

SEQ ID NO: 52582 - protein, 790 aa, Homo sapiens
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 52583 - protein, 394 aa, Homo sapiens
MITVNPDGKIMVRRCLVTLRPFRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQRQRRLRSSQEQARCGVMGACEKMLLEGDVASNTLLIEKPSKKETEKCPKNLVT

SEQ ID NO: 52584 - protein, 801 aa, Homo sapiens
MHSFVKHLCSRYVVERQGTMALPALLTRLLPLRRLFVLGIGFFTLCFLMTSLGGQFSARRLGDSPFTIRTEVMGGPESRGVLRKMSDLLELMVKRMDALARLENSSELHRAGGDLHFPADRMPPGAGLMERIQAIAQNVSDIAVKVDQILRHSLLLHSKVSEGRRDQCEAPSDPKFPDCSGKVEWMRARWTSDPCYAFFGVDGTECSFLIYLSEVEWFCPPLPWRNQTAAQRAPKPLPKVQAVFRSNLSHLLDLMGSGKESLIFMKKRTKRLTAQWALAAQRLAQKLGATQRDQKQILVHIGFLTEESGDVFSPRVLKGGPLGEMVQWADILTALYVLGHGLRVTVSLKELQSNLGVPPGRGSCPLTMPLPFDLIYTDYHGLQQMKRHMGLSFKKYRCRIRVIDTFGTEPAYNHEEYATLHGYRTNWGYWNLNPKQFMTMFPHTPDNSFMGFVSEELNETEKRLIKGGKASNMAVVYGKEASIWKGKEKFLGILNKYMEIHGTVYYESQRPPEVPAFVKNHGLLPQPEFQQLLRKAKLFIGFGFPYEGPAPLEAIANGCIFLQSRFSPPHSSLNHEFFRGKPTSREVFSQHPYAENFIGKPHVWTVDYNNSEEFEAAIKAIMRTQVDPYLPYEYTCEGMLERIHAYIQHQDFCRAPDPALPEAHAPQSPFVLAPNATHLEWARNTSLAPGAWPPAHALRAWLAVPGRACTDTCLDHGLICEPSFFPFLNSQDAFLKLQVPCDSTESEMNHLYPAFAQPGQECYLQKEPLLFSCAGSNTKYRRLCPCRDFRKGQVALCQGCL

SEQ ID NO: 52585 - protein, 533 aa, Homo sapiens
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGGRGARRKWVECVCLPGWHGPSCGVPTVVQYSNLPTKERLVPREVPRRVINAINVNHEFDLLDVRFHELGDVVDAFVVCESNFTAYGEPRPLKFREMLTNGTFEYIRHKVLYVFLDHFPPGGRQDGWIADDYLRTFLTQDGVSRLRNLRPDDVFIIDDADEIPARDGVLFLKLYDGWTEPFAFHMRKSLYGFFWKQPGTLEVVSGCTVDMLQAVYGLDGIRLRRRQYYTMPNFRQYENRTGHILVQWSLGSPLHFAGWHCSWCFTPEGIYFKLVSAQNGDFPRWGDYEDKRDLNYIRGLIRTGGWFDGTQQEYPPADPSEHMYAPKYLLKNYDRFHYLLDNPYQEPRSTAAGGWRHRGPEGRPPARGKLDEAEV

SEQ ID NO: 52586 - protein, 108 aa, Homo sapiens
MESCSCHPGSGVQWRDHGSLQLPPPGFKMKMRRYKLFLMFCMAGLCLISFLHFFKTLSYVTFPRELASLSPNLVSSFFWNNAPVTPQASPEPGGPDLLRTPLYSHSPL

SEQ ID NO: 52587 - protein, 161 aa, Homo sapiens
MKMRRYKLFLMFCMAGLCLISFLHFFKTLSYVTFPRELASLSPNLVSSFFWNNAPVTPQASPEPGGPDLLRTPLYSHSPLLQPLPPSKAAEELHRVDLVLPEDTTEYFVRTKAGGVCFKPGTKMLERPPPGRPEEKPEGANGSSARRPPRYLLSARERTGG

SEQ ID NO: 52588 - protein, 347 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGEQQHNGPDALRS

SEQ ID NO: 52589 - protein, 329 aa, Homo sapiens
MAKSMPSKSSRNKQGTVGVGCFERWRRCISVRETSSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 52590 - protein, 424 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 52591 - protein, 465 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKDKVSLCHLGWSAMAPSGLTAAPTSLGSSDPPTSASQVAGTTGIAHRDLKPENILCESPEKVSPVKICDFDLGSGMKLNNSCTPITTPELTTPCGSAEYMAPEVVEVFTDQATFYDKRCDLWSLGVVLYIMLSGYPPFVGHCGADCGWDRGEVCRVCQNKLFESIQEGKYEFPDKDWAHISSEAKDLISKLLVRDAKQRLSAAQVLQHPWVQGQAPEKGLPTPQVLQRNSSTMDLTLFAAEAIALNRQLSQHEENELAEEPEALADGLCSMKLSPPCKSRLARRRALAQAGRGEDRSPPTAL

SEQ ID NO: 52592 - protein, 347 aa, Homo sapiens; identical to SEQ ID NO: 52588

SEQ ID NO: 52593 - protein, 178 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGSILAHIQKQKHFNEREASRVVRDVAAALDFLHTKGIAHRDLKPENILC

SEQ ID NO: 52594 - protein, 101 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQC

SEQ ID NO: 52595 - protein, 100 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQ

SEQ ID NO: 52596 - protein, 133 aa, Homo sapiens
MVSSQKLEKPIEMGSSEPLPIADGDRRRKKKRRGRATDSLPGKFEDMYKLTSELLGEGAYAKVQGAVSLQNGKEYAVKIIEKQAGHSRSRVFREVETLYQCQGNKNILELIEFFEDDTRFYLVFEKLQGGTYR

SEQ ID NO: 52597 - protein, 465 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 52598 - protein, 414 aa, Homo sapiens
MVQKKPAELQGFHRSFKGQNPFELAFSLDQPDHGDSDFGLQCSARPDMPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRWDSHFLLPPHPCRIHVRPGGLVRTVTVNE

SEQ ID NO: 52599 - protein, 334 aa, Homo sapiens
MLYQCQGHRNVLELIEFFEEEDRFYLVFEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 52600 - protein, 405 aa, Homo sapiens
MPASQPIDIPDAKKRGKKKKRGRATDSFSGRFEDVYQLQEDVLGEGAHARVQTCINLITSQEYAVKIIEKQPGHIRSRVFREVEMLYQCQGHRNVLELIEKMRGGSILSHIHKRRHFNELEASVVVQDVASALDFLHNKGIAHRDLKPENILCEHPNQVSPVKICDFDLGSGIKLNGDCSPISTPELLTPCGSAEYMAPEVVEAFSEEASIYDKRCDLWSLGVILYILLSGYPPFVGRCGSDCGWDRGEACPACQNMLFESIQEGKYEFPDKDWAHISCAAKDLISKLLVRDAKQRLSAAQVLQHPWVQGCAPENTLPTPMVLQRNSCAKDLTSFAAEAIAMNRQLAQHDEDLAEEEAAGQGQPVLVRATSRCLQLSPPSQSKLAQRRQRASLSSAPVVLVGDHA

SEQ ID NO: 52601 - protein, 795 aa, Homo sapiens
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIVKLFEVIETEKTLYLVMEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRDPSEGEASGRTDTSRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 52602 - protein, 758 aa, Homo sapiens
MSARTPLPTVNERDTENHTSVDGYTEPHIQPTKSSSRQNIPRCRNSITSATDEQPHIGNYRLQKTIGKGNFAKVKLARHVLTGREVAVKIIDKTQLNPTSLQKLFREVRIMKILNHPNIGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 52603 - protein, 645 aa, Homo sapiens
MEYASGGEVFDYLVAHGRMKEKEARAKFRQIVSAVQYCHQKYIVHRDLKAENLLLDGDMNIKIADFGFSNEFTVGNKLDTFCGSPPYAAPELFQGKKYDGPEVDVWSLGVILYTLVSGSLPFDGQNLKELRERVLRGKYRIPFYMSTDCENLLKKLLVLNPIKRGSLEQIMKDRWMNVGHEEEELKPYTEPDPDFNDTKRIDIMVTMGFARDEINDALINQKYDEVMATYILLGRKPPEFEGGESLSSGNLCQRSRPSSDLNNSTLQSPAHLKVQRSISANQKQRRFSDHAGPSIPPAVSYTKRPQANSVESEQKEEWDKDVARKLGSTTVGSKSEMTASPLVGPERKKSSTIPSNNVYSGGSMARRNTYVCERTTDRYVALQNGKDSSLTEMSVSSISSAGSSVASAVPSARPRHQKSMSTSGHPIKVTLPTIKDGSEAYRPGTTQRVPAASPSAHSISTATPDRTRFPRGSSSRSTFHGEQLRERRSVAYNGPPASPSHETGAFAHARRGTSTGIISKITSKFVRRSTSGEPKERDKEEGKDSKPRSLRFTWSMKTTSSMDPNDMMREIRKVLDANNCDYEQKERFLLFCVHGDARQDSLVQWEMEVCKLPRLSLNGVRFKRISGTSIAFKNIASKIANELKL

SEQ ID NO: 52604 - protein, 779 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52605 - protein, 709 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52606 - protein, 719 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52607 - protein, 773 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52608 - protein, 691 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52609 - protein, 788 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52610 - protein, 691 aa, Homo sapiens; identical to SEQ ID NO: 52608

SEQ ID NO: 52611 - protein, 734 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLSFRFARRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52612 - protein, 780 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPRQVTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52613 - protein, 41 aa, Homo sapiens
MSSARTPLPTLNERDTEQPTLGHLDSKPSSKSNMIRGRNSA

SEQ ID NO: 52614 - protein, 724 aa, Homo sapiens
MSSARTPLPTLNERDTEQPTLGHLDSKPSSKSNMIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52615 - protein, 61 aa, Homo sapiens [sequence omitted]

SEQ ID NO: 52616 - protein, 112 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHG

SEQ ID NO: 52617 - protein, 161 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADF

SEQ ID NO: 52618 - protein, 91 aa, Homo sapiens
MGGQRNTSVGNIVQRWRDHVVCQKAGVIYSGRKAQEHGTGRTDFTPAQRLMMPTLGHLDSKPSSKSNMIRGRNSATSADEQPHIGNYRLLK

SEQ ID NO: 52619 - protein, 745 aa, Homo sapiens
MIRGRNSATSADEQPHIGNYRLLKTIGKGNFAKVKLARHILTGKEVAVKIIDKTQLNSSSLQKLFREVRIMKVLNHPNIVKLFEVIETEKTLYLVMEYASGGEVFDYLVAHGRMKEKEARAKFRQIVSAVQYCHQKFIVHRDLKAENLLLDADMNIKIADFGFSNEFTFGNKLDTFCGSPPYAAPELFQGKKYDGPEVDVWSLGVILYTLVSGSLPFDGQNLKELRERVLRGKYRIPFYMSTDCENLLKKFLILNPSKRGTLEQIMKDRWMNVGHEDDELKPYVEPLPDYKDPRRTELMVSMGYTREEIQDSLVGQRYNEVMATYLLLGYKSSELEGDTITLKPRPSADLTNSSAPSPSHKVQRSVSANPKQRRFSDQAGPAIPTSNSYSKKTQSNNAENKRPEEDRESGRKASSTAKVPASPLPGLERKKTTPTPSTNSVLSTSTNRSRNSPLLERASLGQASIQNGKDSLTMPGSRASTASASAAVSAARPRQHQKSMSASVHPNKASGLPPTESNCEVPRPSTAPQRVPVASPSAHNISSSGGAPDRTNFPRGVSSRSTFHAGQLRQVRDQQNLPYGVTPASPSGHSQGRRGASGSIFSKFTSKFVRRNLNEPESKDRVETLRPHVVGSGGNDKEKEEFREAKPRSLRFTWSMKTTSSMEPNEMMREIRKVLDANSCQSELHEKYMLLCMHGTPGHEDFVQWEMEVCKLPRLSLNGVRFKRISGTSMAFKNIASKIANELKL

SEQ ID NO: 52620 - protein, 713 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52621 - protein, 729 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52622 - protein, 445 aa, Homo sapiens
MKYDEITATYLLLGRKSSELDASDSSSSSNLSLAKVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSLTEMFAYAASPASVCTSTCRLRHQKSMSMSASGHPKMMLPPIDSEGDNFKAITIPDQRTPVASTHSISSAATPDRIRFPRGTASRSTFHGQPRERRTATYNGPPASPSLSHEATPLSQTRSRGSTNLFSKLTSKLTRRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52623 - protein, 752 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQGCQAGQTIKVQVSFDLLSLMFTFIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52624 - protein, 753 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52625 - protein, 659 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52626 - protein, 744 aa, Homo sapiens
MSTRTPLPTVNERDTENHTSHGDGRQEVTSRTSRSGARCRNSIASCADEQPHIGNYRLLKTIGKGNFAKVKLARHILTGREVAIKIIDKTQLNPTSLQKLFREVRIMKILNHPNIVKLFEVIETEKTLYLIMEYASGGEVFDYLVAHGRMKEKEARSKFRQIVSAVQYCHQKRIVHRDLKAENLLLDADMNIKIADFGFSNEFTVGGKLDTFCGSPPYAAPELFQGKKYDGPEVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSELDASDSSSSSNLSLAKVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52627 - protein, 505 aa, Homo sapiens
  MOD_RES (1)..(1): Any amino acid
XVDVWSLGVILYTLVSGSLPFDGQNLKELRERVLRGKYRIPFYMSTDCENLLKRFLVLNPIKRGTLEQIMKDRWINAGHEEDELKPFVEPELDISDQKRIDIMVGMGYSQEEIQESLSKMKYDEITATYLLLGRKSSEVRPSSDLNNSTGQSPHHKVQRSVFSSQKQRRYSDHAGPAIPSVVAYPKRSQTSTADSDLKEDGISSRKSSGSAVGGKGIAPASPMLGNASNPNKADIPERKKSSTVPSSNTASGGMTRRNTYVCSERTTADRHSVIQNGKENSTIPDQRTPVASTHSISSAATPDRIRFPRGTASRSTFHGQPRERRTATYNGPPASPSLSHEATPLSQTRSRGSTNLFSKLTSKLTRRNMSFRFIKRLPTEYERNGRYEGSSRNVSAEQKDENKEAKPRSLRFTWSMKTTSSMDPGDMMREIRKVLDANNCDYEQRERFLLFCVHGDGHAENLVQWEMEVCKLPRLSLNGVRFKRISGTSIAFKNIASKIANELKL

SEQ ID NO: 52628 - protein, 752 aa, Homo sapiens
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVADEPERIGGPEVTSCHLPWDQTETAPRLLRFPWSVKLTSSRPPEALMAALRQATAAARCRCRQPQPFLLACLHGGAGGPEPLSHFEVEVCQLPRPGLRGVLFRRVAGTALAFRTLVTRISNDLEL

SEQ ID NO: 52629 - protein, 462 aa, Homo sapiens
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEPPTLSALPLCHLPLPLHLTLTPLGLCPAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEPDEHGGGGAEGGAAARPEGELQHRGEWESRAAPLQPHGQQRPQPQQGRDPRAAEGQHEHP

SEQ ID NO: 52630 - protein, 688 aa, Homo sapiens
MSSRTVLAPGNDRNSDTHGTLGSGRSSDKGPSWSSRSLGARCRNSIASCPEEQPHVGNYRLLRTIGKGNFAKVKLARHILTGREVAIKIIDKTQLNPSSLQKLFREVRIMKGLNHPNIVKLFEVIETEKTLYLVMEYASAGEVFDYLVSHGRMKEKEARAKFRQIVSAVHYCHQKNIVHRDLKAENLLLDAEANIKIADFGFSNEFTLGSKLDTFCGSPPYAAPELFQGKKYDGPEVDIWSLGVILYTLVSGSLPFDGHNLKELRERVLRGKYRVPFYMSTDCESILRRFLVLNPAKRCTLEQIMKDKWINIGYEGEELKPYTEPEEDFGDTKRIEVMVGMGYTREEIKESLTSQKYNEVTATYLLLGRKTEEGGDRGAPGLALARVRAPSDTTNGTSSSKGTSHSKGQRSSSSTYHRQRRHSDFCGPSPAPLHPKRSPTSTGEAELKEERLPGRKASCSTAGSGSRGLPPSSPMVSSAHNPNKAEIPERRKDSTSTPNNLPPSMMTRRNTYVCTERPGAERPSLLPNGKENSSGTPRVPPASPSSHSLAPPSGERSRLARGSTIRSTFHGGQVRDRRAGGGGGGGVQNGPPASPTLAHEAAPLPAGRPRPTTNLFTKLTSKLTRRVTLDPSKRQNSNRCVSGASLPQGSKIRSQTNLRESGDLRSQVAIYLGIKRKPPPGCSDSPGV

SEQ ID NO: 52631 - protein, 79 aa, Homo sapiens
MAALRQATAAARCRCRQPQPFLLACLHGGAGGPEPLSHFEVEVCQLPRPGLRGVLFRRVAGTALAFRTLVTRISNDLEL

SEQ ID NO: 52632 - protein, 343 aa, Homo sapiens
MAAATELNRPSSGDRNLERRCRPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVSFSGKRRKVQPPQNYSLAELDEKISALKQALLRKSREAESMATHHLP

SEQ ID NO: 52633 - protein, 344 aa, Homo sapiens
MAAATELNRPSSGDRNLERRCRPNLSREVLYEIFRSLHTLVGQLDLRDDVVKITIDWNKLQSLSAFQPALLFSALEQHILYLQPFLAKLQSPIKEENTTAVEEIGRTEMGNKNEVNDKFSIGDLQEEEKHKESDLRDVKKTQIHFDPEVVQIKAGKAEIDRRISAFIERKQAEINENNVREFCNVIDCNQENSCARTDAIFTPYPGFKSHVKVSRVVNTYGPQTRPEGIPGSGHKPNSMLRDCGNQAVEERLQNIEAHLRLQTGGPVPRDIYQRIKKLEDKILELEGISPEYFQSVSFSGKRRKVQPPQQNYSLAELDEKISALKQALLRKSREAESMATHHLP

SEQ ID NO: 52634 - protein, 1647 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 52635 - protein, 1588 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 52636 - protein, 1608 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 52637 - protein, 1581 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIELWNKHQEVKKQKALEKQRPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGRDKGSMWDQLEDAAMETFSISKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 52638 - protein, 1479 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQLLRRLRW

SEQ ID NO: 52639 - protein, 1541 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 52640 - protein, 1587 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGSVRRRIYDNPYFEPQYGFPPEEDEDEQGESYTPRFSQHVSGNRAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 52641 - protein, 1545 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 52642 - protein, 1479 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQFLKLKKW

SEQ ID NO: 52643 - protein, 1565 aa, Homo sapiens
MVQKKKFCPRLLDYLVIVGARHPSSDSVAQTPELLRRYPLEDHTEFPLPPDVVFFCQPEGCLSVRQRRMSLRDDTSFVFTLTDKDTGVTRYGICVNFYRSFQKRISKEKGEGGAGSRGKEGTHATCASEEGGTESSESGSSLQPLSADSTPDVNQSPRGKRRAKAGSRSRNSTLTSLCVLSHYPFFSTFRECLYTLKRLVDCCSERLLGKKLGIPRGVQRDTMWRIFTGSLLVEEKSSALLHDLREIEAWIYRLLRSPVPVSGQKRVDIEVLPQELQPALTFALPDPSRFTLVDFPLHLPLELLGVDACLQVLTCILLEHKVVLQSRDYNALSMSVMAFVAMIYPLEYMFPVIPLLPTCMASAEQLLLAPTPYIIGVPASFFLYKLDFKMPDDVWLVDLDSNRVIAPTNAEVLPILPEPESLELKKHLKQALASMSLNTQPILNLEKFHEGQEIPLLLGRPSNDLQSTPSTEFNPLIYGNDVDSVDVATRVAMVRFFNSANVLQGFQMHTRTLRLFPRPVVAFQAGSFLASRPRQTPFAEKLARTQAVEYFGEWILNPTNYAFQRIHNNMFDPALIGDKPKWYAHQLQPIHYRVYDSNSQLAEALSVPPERDSDSEPTDDSGSDSMDYDDSSSSYSSLGDFVSEMMKCDINGDTPNVDPLTHAALGDASEVEIDELQNQKEAEEPGPDSENSQENPPLRSSSSTTASSSPSTVIHGANSEPADSTEMDDKAAVGVSKPLPSVPPSIGKSNVDRRQAEIGEGAQKLLRPNSLRLASDSDAESDSRASSPNSTVSNTSTEGFGGIMSFASSLYRNHSTSFSLSNLTLPTKGAREKATPFPSLKVFGLNTLMEIVTEAGPGSGEGNRRALVDQKSSVIKHSPTVKREPPSPQGRSSNSSENQQFLKEVVHSVLDGQGVGWLNMKKVRRLLESEQLRVFVLSKLNRMVQSEDDARQDIIPDVEISRKVYKGMLDLLKCTVLSLEQSYAHAGLGGMASIFGLLEIAQTHYYSKEPDKRKRSPTESVNTPVGKDPGLAGRGDPKAMAQLRVPQLGPRAPSATGKGPKELDTRSLKEENFIASIGPEVIKPVFDLGETEEKKSQISADSGVSLTSSSQRTDQDSVIGVSPAVMIRSSSQDSEVSTVVSNSSGETLGADSDLSSNAGDGPGGEGSVHLASSRGTLSDSEIETNSATSTIFGKAHSLKPSIKEKLAGSPIRTSEDVSQRVYLYEGLLGKERSTLWDQMQFWEDAFLDAVMLEREGMGMDQGPQEMIDRYLSLGEHDRKRLEDDEDRLLATLLHNLISYMLLMKVNKNDIRKKVRRLMGKSHIGLVYSQQINEVLDQLANLNGRDLSIWSSGSRHMKKQTFVVHAGTDTNGDIFFMEVCDDCVVLRSNIGTVYERWWYEKLINMTYCPKTKVLCLWRRNGSETQLNKFYTKKCRELYYCVKDSMERAAARQQSIKPGPELGGEFPVQDLKTGEGGLLQVTLEGINLKFMHNQVFIELNHIKKCNTVRGVFVLEEFVPEIKEVVSHKYKTPMAHEICYSVLCLFSYVAAVHSSEEDLRTPPRPVSS

SEQ ID NO: 52644 - protein, 195 aa, Homo sapiens
MGSQSSKAPRGDVTAEEAAGASPAKANGQENGHVKSNGDLSPKGEGESPPVNGTDEAAGATGDAIEPAPPSQGAEAKGEVPPKETPKKKKKFSFKKPFKLSGLSFKRNRKEGGGDSSASSPTEEEQEQGEIGACSDEGTAQEGKAAATPESQEPQAKGAEASAASEEEAGPQATEPSTPSGPESGPTPASAEQNE

SEQ ID NO: 52645 - protein, 458 aa, Homo sapiens
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPPRPANFFVFLVEMGFHRVSQDDLDLLTS

SEQ ID NO: 52646 - protein, 558 aa, Homo sapiens
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 52647 - protein, 442 aa, Homo sapiens
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSIALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 52648 - protein, 546 aa, Homo sapiens
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQECEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKKKNDPTFLEKKERCDYLKNKLSHIKQRIQEYDKVMNWDVQGYS

SEQ ID NO: 52649 - protein, 516 aa, Homo sapiens
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFSSRKEADAVFPRDPYGSLDRHTQTVRTYSEKVEEYNLRYSYMKSWAGLLRILGVVELLLGAGVFACVTAYIHKDSEWYNLFGYSQPYGMGGVGGLGSMYGGYYYTGPKTPFVLVVAGLAWITTIIILVLGMSMYYRTILLDSNWWPLTEFGINVALFILYMAAAIVYVNDTNRGGLCYYPLFNTPVNAVFCRVEGGQIAAMIFLFVTMIVYLISALVCLKLWRHEAARRHREYMEQQEINEPSLSSKRKMCEMATSGDRQRDSEVNFKELRTAKMKPELLSGHIPPGHIPKPIVMPDYVAKYPVIQTDDERERYKAVFQDQFSEYKELSAEVQAVLRKFDELDAVMSRLPHHSESRQEHERISRIHEEFKKK

SEQ ID NO: 52650 - protein, 145 aa, Homo sapiens
MSNDGRSRNRDRRYDEVPSDLPYQDTTIRTHPTLHDSERAVSADPLPPPPLPLQPPFGPDFYSSDTEEPAIAPDLKPVRRFVPDSWKNFFRGKKKDPEWDKPVSDIRYISDGVECSPPASPARPNHRSPLNSCKDPYGGSEGTFS

SEQ ID NO: 52651 - protein, 401 aa, Homo sapiens
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRACCQMLEVLLNLLILACSSVSYSSTGGYTGITSLGGIYYYQFGGAYSGFDGADGEKAQQLDVQFYQLKLPMVTVAMACSGALTALCCLFVAMGVLRVPWHCPLLLVTEGLLDMLIAGGYIPALYFYFHYLSAAYGSPVCKERQALYQSKGYSGFGCSFHGADIGAGIFAALGIVVFALGAVLAIKGYRKVRKLKEKPAEMFEF

SEQ ID NO: 52652 - protein, 410 aa, Homo sapiens
MEDPSGAREPRARPRERDPGRRPHPDQGRTHDRPRDRPGDPRRKRSSDGNRRRDGDRDPERDQERDGNRDRNRDRERERERERDPDRGPRRDTHRDAGPRAGEHGVWEKPRQSRTRDGARGLTWDAAAPPGPAPWEAPEPPQPQRKGDPGRRRPESEPPSERYLPSTPRPGREEVEYYQSEAEGLLECHKCKYLCTGRGVVQIVEVVLNGMVLICIVASYFVLAGFSASFSSGGGFGNNYYSPFEGTELEQVRQLDQQYTILRSPLIYGGVAVSLGLGVLTMGVLLQGAKSRTMLSGKWLLTEAAFSLLAAVGYCTGIGVYLHVALQINSTDTCKTRERLYARKGLTWMDCQLAGTDGAAATFACLLVIMYGASVVLALRSYREQKRYKGSREQPGSYSDAPEYLWSGTL

SEQ ID NO: 52653 - protein, 325 aa, Homo sapiens
MDGSNVTSFVVEEPTNISTGRNASVGNAHRQIPIVHWVIMSISPVGFVENGILLWFLCFRMRRNPFTVYITHLSIADISLLFCIFILSIDYALDYELSSGHYYTIVTLSVTFLFGYNTGLYLLTAISVERCLSVLYPIWYRCHRPKYQSALVCALLWALSCLVTTMEYVMCIDREEESHSRNDCRAVIIFIAILSFLVFTPLMLVSSTILVVKIRKNTWASHSSKLYIVIMVTIIIFLIFAMPMRLLYLLYYEYWSTFGNLHHISLLFSTINSSANPFIYFFVGSSKKKRFKESLKVVLTRAFKDEMQPRRQKDNCNTVTVETVV

SEQ ID NO: 52654 - protein, 378 aa, Homo sapiens
MVWGKICWFSQRAGWTVFAESQISLSCSLCLHSGDQEAQNPNLVSQLCGVFLQNETNETIHMQMSMAVGQQALPLNIIAPKAVLVSLCGVLLNGTVFWLLCCGATNPYMVYILHLVAADVIYLCCSAVGFLQVTLLTYHGVVFFIPDFLAILSPFSFEVCLCLLVAISTERCVCVLFPIWYRCHRPKYTSNVVCTLIWGLPFCINIVKSLFLTYWKHVKACVIFLKLSGLFHAILSLVMCVSSLTLLIRFLCCSQQQKATRVYAVVQISAPMFLLWALPLSVAPLITDFKMFVTTSYLISLFLIINSSANPIIYFFVGSLRKKRLKESLRVILQRALADKPEVGRNKKAAGIDPMEQPHSTQHVENLLPREHRVDVET

SEQ ID NO: 52655 - protein, 378 aa, Homo sapiens; identical to SEQ ID NO: 52654

SEQ ID NO: 52656 - protein, 378 aa, Homo sapiens; identical to SEQ ID NO: 52654

SEQ ID NO: 52657 - protein, 378 aa, Homo sapiens; identical to SEQ ID NO: 52654

SEQ ID NO: 52658 - protein, 378 aa, Homo sapiens; identical to SEQ ID NO: 52654

SEQ ID NO: 52659 - protein, 378 aa, Homo sapiens; identical to SEQ ID NO: 52654

SEQ ID NO: 52660 - protein, 378 aa, Homo sapiens; identical to SEQ ID NO: 52654

SEQ ID NO: 52661 - protein, 378 aa, Homo sapiens; identical to SEQ ID NO: 52654

SEQ ID NO: 52662 - protein, 321 aa, Homo sapiens
MNQTLNSSGTVESALNYSRGSTVHTAYLVLSSLAMFTCLCGMAGNSMVIWLLGFRMHRNPFCIYILNLAAADLLFLFSMASTLSLETQPLVNTTDKVHELMKRLMYFAYTVGLSLLTAISTQRCLSVLFPIWFKCHRPRHLSAWVCGLLWTLCLLMNGLTSSFCSKFLKFNEDRCFRVDMVQAALIMGVLTPVMTLSSLTLFVWVRRSSQQWRRQPTRLFVVVLASVLVFLICSLPLSIYWFVLYWLSLPPEMQVLCFSLSRLSSSVSSSANPVIYFLVGSRRSHRLPTRSLGTVLQQALREEPELEGGETPTVGTNEMGA

SEQ ID NO: 52663 - protein, 311 aa, Homo sapiens
MEPREAGQHVGAANGAQEDVAFNLIILSLTEGLGLGGLLGNGAVLWLLSSNVYRNPFAIYLLDVACADLIFLGCHMVAIVPDLLQGRLDFPGFVQTSLATLRFFCYIVGLSLLAAVSVEQCLAALFPAWYSCRRPRHLTTCVCALTWALCLLLHLLLSGACTQFFGEPSRHLCRTLWLVAAVLLALLCCTMCGASLMLLLRVERGPQRPPPRGFPGLILLTVLLFLFCGLPFGIYWLSRNLLWYIPHYFYHFSFLMAAVHCAAKPVVYFCLGSAQGRRLPLRLVLQRALGDEAELGAVRETSRRGLVDIAA

SEQ ID NO: 52664 - protein, 312 aa, Homo sapiens
MMEPREAGQHVGAANGAQEDVAFNLIILSLTEGLGLGGLLGNGAVLWLLSSNVYRNPFAIYLLDVACADLIFLGCHMVAIVPDLLQGRLDFPGFVQTSLATLRFFCYIVGLSLLAAVSVEQCLAALFPAWYSCRRPRHLTTCVCALTWALCLLLHLLLSGACTQFFGEPSRHLCRTLWLVAAVLLALLCCTMCGASLMLLLRVERGPQRPPPRGFPGLILLTVLLFLFCGLPFGIYWLSRNLLWYIPHYFYHFSFLMAAVHCAAKPVVYFCLGSAQGRRLPLRLVLQRALGDEAELGAVRETSRRGLVDIAA

SEQ ID NO: 52665 - protein, 343 aa, Homo sapiens
MAGNCSWEAHPGNRNKMCPGLSEAPELYSRGFLTIEQIAMLPPPAVMNYIFLLLCLCGLVGNGLVLWFFGFSIKRNPFSIYFLHLASADVGYLFSKAVFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 52666 - protein, 315 aa, Homo sapiens
MAGNCSWEAHPGNRNKMCPGLSEAPELYSRGFLTIEQIAMLPPPAVMNYIFLLLCLCGLVGNGLVLWFFGFSILNTGGFLGTFADYIRSVCRVLGLCMFLTGVSLLPAVSAERCASVIFPAWYWRRRPKRLSAVVCALLWVLSLLVTCLHNYFCVFLGRGAPGAACRHMDIFLGILLFLLCCPLMVLPCLALILHVECRARRRQRSAKLNHVILAMVSVFLVSSIYLGIDWFLFWVFQIPAPFPEYVTDLCICINSSAKPIVYFLAGRDKSQRLWEPLRVVFQRALRDGAELGEAGGSTPNTVTMEMQCPPGNAS

SEQ ID NO: 52667 - protein, 343 aa, Homo sapiens; identical to SEQ ID NO: 52665

SEQ ID NO: 52668 - protein, 289 aa, Homo sapiens
MFGLFGLWRTFDSVVFYLTLIVGLGGPVGNGLVLWNLGFRIKKGPFSIYLLHLAAADFLFLSCRVGFSVAQAALGAQDTLYFVLTFLWFAVGLWLLAAFSVERCLSDLFPACYQGCRPRHASAVLCALVWTPTLPAVPLPANACGLLRNSACPLVCPRYHVASVTWFLVLARVAWTAGVVLFVWVTCCSTRPRPRLYGIVLGALLLLFFCGLPSVFYWSLQPLLNFLLPVFSPLATLLACVNSSSKPLIYSGLGRQPGKREPLRSVLRRALGEGAELGARGQSLPMGLL

SEQ ID NO: 52669 - protein, 322 aa, Homo sapiens
MDPTISTLDTELTPINGTEETLCYKQTLSLTVLTCIVSLVGLTGNAVVLWLLGCRMRRNAFSIYILNLAAADFLFLSGRLIYSLLSFISIPHTISKILYPVMMFSYFAGLSFLSAVSTERCLSVLWPIWYRCHRPTHLSAVVCVLLWALSLLRSILEWMLCGFLFSGADSAWCQTSDFITVAWLIFLCVVLCGSSLVLLIRILCGSRKIPLTRLYVTILLTVLVFLLCGLPFGIQFFLFLWIHVDREVLFCHVHLVSIFLSALNSSANPIIYFFVGSFRQRQNRQNLKLVLQRALQDASEVDEGGGQLPEEILELSGSRLEQ

SEQ ID NO: 52670 - protein, 330 aa, Homo sapiens
MDPTTPAWGTESTTVNGNDQALLLLCGKETLIPVFLILFIALVGLVGNGFVLWLLGFRMRRNAFSVYVLSLAGADFLFLCFQIINCLVYLSNFFCSISINFPSFFTTVMTCAYLAGLSMLSTVSTERCLSVLWPIWYRCRRPRHLSAVVCVLLWALSLLLSILEGKFCGFLFSDGDSGWCQTFDFITAAWLIFLFMVLCGSSLALLVRILCGSRGLPLTRLYLTILLTVLVFLLCGLPFGIQWFLILWIWKDSDVLFCHIHPVSVVLSSLNSSANPIIYFFVGSFRKQWRLQQPILKLALQRALQDIAEVDHSEGCFRQGTPEMSRSSLV

SEQ ID NO: 52671 - protein, 322 aa, Homo sapiens
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPLTRLYVTILLTVLVFLLCGLPFGIQWALFSRIHLDWKVLFCHVHLVSIFLSALNSSANPIIYFFVGSFRQRQNRQNLKLVLQRALQDTPEVDEGGGWLPQETLELSGSRLEQ

SEQ ID NO: 52672 - protein, 246 aa, Homo sapiens
MDSTIPVLGTELTPINGREETPCYKQTLSFTGLTCIVSLVALTGNAVVLWLLGCRMRRNAVSIYILNLVAADFLFLSGHIICSPLRLINIRHPISKILSPVMTFPYFIGLSMLSAISTERCLSILWPIWYHCRRPRYLSSVMCVLLWALSLLRSILEWMFCDFLFSGANSVWCETSDFITIAWLVFLCVVLCGSSLVLLVRILCGSRKMPLTRLYVTILLTVLVFLLCGLPFGIQWALFSRIHLDW

SEQ ID NO: 52673 - protein, 322 aa, Homo sapiens
MDPTVPVFGTKLTPINGREETPCYNQTLSFTVLTCIISLVGLTGNAVVLWLLGYRMRRNAVSIYILNLAAADFLFLSFQIIRLPLRLINISHLIRKILVSVMTFPYFTGLSMLSAISTERCLSVLWPIWYRCRRPTHLSAVVCVLLWGLSLLFSMLEWRFCDFLFSGADSSWCETSDFIPVAWLIFLCVVLCVSSLVLLVRILCGSRKMPLTRLYVTILLTVLVFLLCGLPFGILGALIYRMHLNLEVLYCHVYLVCMSLSSLNSSANPIIYFFVGSFRQRQNRQNLKLVLQRALQDKPEVDKGEGQLPEESLELSGSRLGP

SEQ ID NO: 52674 - protein, 1016 aa, Homo sapiens
MVLPTCPMAEFALPRHSAVMERLRRRIELCRRHHSTCEARYEAVSPERLELERQHTFALHQRCIQAKAKRAGKHRQPPAATAPAPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTGSSAAVPGMNTLGPSNSSCPRVFPQAGNLMPMGPGHASVSSLPTNSGQQDRGVAQFPGSQNMPQSSLYGMASGITQIVAQPPPQATNGHAHIPRQTNVGQNTSVSAAYGQNSLGSSGLSQQHNKGTLNPGLTKPPVPRVSPAMGGQNSSWQHQGMPNLSGQTPGNSNVSPFTAASSFHMQQQAHLKMSSPQFSQAVPNRPMAPMSSAAAVGSLLPPVSAQQRTSAPAPAPPPTAPQQGLPGLSPAGPELGAFSQSPASQMGGRAGLHCTQAYPVRTAGQELPFAYSGQPGGSGLSSVAGHTDLIDSLLKNRTSEEWMSDLDDLLGSQ

SEQ ID NO: 52675 - protein, 761 aa, Homo sapiens
RGKQWGRGGGERPRLEVGSKRRLGVGPSGAGGKPAAAREPAPLPSGAWRGREAERGSRGERSPQCQPAPRGPAPGPARAARGPWCCPPAPWRSSRCRGTARSWSAFAGASSCAGATTAPARPAAPAPRLDAADGPEHGRPATHLHDTVKRNLDSATSPQNGDQQNGYGDLFPGHKKTRREAPLGVAISSNGLPPASPLGQSDKPSGADALQSSGKHSLGLDSLNKKRLADSSLHLNGGSNPSESFPLSLNKELKQEPVEDLPCMITGTVGSISQSNLMPDLNLNEQEWKELIEELNRSVPDEDMKDLFNEDFEEKKDPESSGSATQTPLAQDINIKTEFSPAAFEQEQLGSPQVRAGSAGQTFLGPSSAPVSTDSPSLGGSQTLFHTSGQPRADNPSPNLMPASAQAQNAQRALAGVVLPSQGPGGASELSSAHQLQQIAAKQKREQMLQNPQQATPAPAPGQMSTWQQTGPSHSSLDVPYPMEKPASPSSYKQDFTNSKLLMMPSVNKSSPRPGGPYLQPSHVNLLSHQPPSNLNQNSANNQGSVLDYGNTKPLSHYKADCGQGSPGSGQSKPALMAYLPQQLSHISHEQNSLFLMKPKPGNMPFRSLVPPGQEQNPSSVPVQAQATSVGTQPPAVSVASSHNSSPYLSSQQQAAVMKQHQLLLDQQKQREQQQKHLQQQQFLQRQQHLLAEQEKQQFQRHLTRPPPQYQDPTQGSFPQQVGQFTAQGLSCALPMIHSTEVLISSLCNGSAGLSAAQRSW

SEQ ID NO: 52676 - protein, 1156 aa, Homo sapiens
MGDTAPPQAPAGGLGGASGAGLLGGGSVTPRVHSAIVERLRARIAVCRQHHLSCEGRYERGRAESSDRERESTLQLLSLVQHGQGARKAGKHTKATATAATTTAPPPPPAAPPAASQAAATAAPPPPPDYHHHHQQHLLNSSNNGGSGGINGEQQPPASTPGDQRNSALIALQGSLKRKQVVNLSPANSKRPNGFVDNSFLDIKRIRVGENLSAGQGGLQINNGQSQIMSGTLPMSQAPLRKTNTLPSHTHSPGNGLFNMGLKEVKKEPGETLSCSKHMDGQMTQENIFPNRYGDDPGEQLMDPELQELFNELTNISVPPMSDLELENMINATIKQDDPFNIDLGQQSQRSTPRPSLPMEKIVIKSEYSPGLTQGPSGSPQLRPPSAGPAFSMANSALSTSSPIPSVPQSQAQPQTGSGASRALPSWQEVSHAQQLKQIAANRQQHARMQQHQQQHQPTNWSALPSSAGPSPGPFGQEKIPSPSFGQQTFSPQSSPMPGVAGGSGQSKVMANYMYKAGPSAQGGHLDVLMQQKPQDLSRSFINNPHPAMEPRQGNTKPLFHFNSDQANQQMPSVLPSQNKPSLLHYTQQQQQQQQQQQQQQQQQQQQQQQQQQQQQQQQQQSSISAQQQQQQQSSISAQQQQQQQQQQQQQQQQQQQQQQQQQQQPSSQPAQSLPSQPLLRSPLPLQQKLLLQQMQNQPIAGMGYQVSQQQRQDQHSVVGQNTGPSPSPNPCSNPNTGSGYMNSQQSLLNQQLMGKKQTLQRQIMEQKQQLLLQQQMLADAEKIAPQDQINRHLSRPPPDYKDQRRNVGNMQPTAQYSGGSSTISLNSNQALANPVSTHTILTPNSSLLSTSHGTRMPSLSTAVQNMGMYGNLPCNQPNTYSVTSGMNQLTQQRNPKQLLANQNNPMMPRPPTLGPSNNNNVATFGAGSVGNSQQLRPNLTHSMASMPPQRTSNVMITSNTTAPNWASQEGTSKQQEALTSAGVRFPTGTPAAYTPNQSLQQAVGSQQFSQRAVAPPNQLTPAVQMRPMNQMSQTLNGQTMGPLRGLNLRPNQLSTQILPNLNQSGTGLNQSRTGINQPPSLTPSNFPSPNQSSRAFQGTDHSSDLAFDFLSQQNDNMGPALNSDADFIDSLLKTEPGNDDWMKDINLDEILGNNS

SEQ ID NO: 52677 - protein, 1156 aa, Homo sapiens; identical to SEQ ID NO: 52676

SEQ ID NO: 52678 - protein, 543 aa, Homo sapiens
LQETVKRKLEGARSPLNGDQQNGACDGNFSPTSKRIRKDISAGMEAINNLPSNMPLPSASPLHQLDLKPSLPLQNSGTHTPGLLEDLSKNGRLPEIKLPVNGCSDLEDSFTILQSKDLKQEPLDDPTCIDTSETSLSNQNKLFSDINLNDQEWQELIDELANTVPEDDIQDLFNEDFEEKKEPEFSQPATETPLSQESASVKSDPSHSPFAHVSMGSPQARPSSSGPPFSTVSTATSLPSVASTPAAPNPASSPANCAVQSPQTPNQAHTPGQAPPRPGNGYLLNPAAVTVAGSASGPVAVPSSDMSPAEQLKQMAAQQQQRAKLMQQKQQQQQQQQQQQQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQEQQPVG

SEQ ID NO: 52679 - protein, 276 aa, Homo sapiens
MSPAEQLKQMAAQQQQRAKLMQQKQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQVSVKVTHSSSSSCGAFDCRCVMFYKSTVVGSNCLQKTSLHPQVVARFGVFFFHFS

SEQ ID NO: 52680 - protein, 1138 aa, Homo sapiens
MGDFAAPAAAANGSSICINSSLNSSLGGAGIGVNNTPNSTPAAPSSNHPAAGGCGGSGGPGGGSAAVPKHSTVVERLRQRIEGCRRHHVNCENRYQQAQVEQLELERRDTVSLYQRTLEQRAKKSGAGTGKQQHPSKPQQDAEAASAEQRNHTLIMLQETVKRKLEGARSPLNGDQQNGACDGNFSPTSKRIRKDISAGMEAINNLPSNMPLPSASPLHQLDLKPSLPLQNSGTHTPGLLEDLSKNGRLPEIKLPVNGCSDLEDSFTILQSKDLKQEPLDDPTCIDTSETSLSNQNKLFSDINLNDQEWQELIDELANTVPEDDIQDLFNEDFEEKKEPEFSQPATETPLSQESASVKSDPSHSPFAHVSMGSPQARPSSSGPPFSTVSTATSLPSVASTPAAPNPASSPANCAVQSPQTPNQAHTPGQAPPRPGNGYLLNPAAVTVAGSASGPVAVPSSDMSPAEQLKQMAAQQQQRAKLMQQKQQQQQQQQQQQQQQQQQQQQQQQQQHSNQTSNWSPLGPPSSPYGAAFTAEKPNSPMMYPQAFNNQNPIVPPMANNLQKTTMNNYLPQNHMNMINQQPNNLGTNSLNKQHNILTYGNTKPLTHFNADLSQRMTPPVANPNKNPLMPYIQQQQQQQQQQQQQQQQQQPPPPQLQAPRAHLSEDQKRLLLMKQKGVMNQPMAYAALPSHGQEQHPVGLPRTTGPMQSSVPPGSGGMVSGASPAGPGFLGSQPQAAIMKQMLIDQRAQLIEQQKQQFLREQRQQQQQQQQQILAEQQLQQSHLPRQHLQPQRNPYPVQQVNQFQGSPQDIAAVRSQAALQSMRTSRLMAQNAGMMGIGPSQNPGTMATAAAQSEMGLAPYSTTPTSQPGMYNMSTGMTQMLQHPNQSGMSITHNQAQGPRQPASGQGVGMVSGFGQSMLVNSAITQQHPQMKGPVGQALPRPQAPPRLQSLMGTVQQGAQSWQQRSLQGMPGRTSGELGPFNNGASYPLQAGQPRLTKQHFPQGLSQSVVDANTGTVRTLNPAAMGRQMMPSLPGQQGTSQARPMVMSGLSQGVPGMPAFSQPPAQQQIPSGSFAPSSQSQAYERNAPQDVSYNYSGDGAGGSFPGLPDGADLVDSIIKGGPGDEWMQELDELFGNP

SEQ ID NO: 52681 - protein, 445 aa, Homo sapiens
EQHPVGLPRTTGPMQSSVPPGSGGMVSGASPAGPGFLGSQPQAAIMKQMLIDQRAQLIEQQKQQFLREQRQQQQQQQQQILAEQQLQQSHLPRQHLQPQRNPYPVQQVNQFQGSPQDIAAVRSQAALQSMRTSRLMAQNAGMMGIGPSQNPGTMATAAAQSEMGLAPYSTTPTSQPGMYNMSTGMTQMLQHPNQSGMSITHNQAQGPRQPASGQGVGMVSGFGQSMLVNSAITQQHPQMKGPVGQALPRPQAPPRLQSLMGTVQQGAQSWQQRSLQGMPGRTSGELGPFNNGASYPLQAGQPRLTKQHFPQGLSQSVVDANTGTVRTLNPAAMGRQMMPSLPGQQGTSQARPMVMSGLSQGVPGMPAFSQPPAQQQIPSGSFAPSSQSQAYERNAPQDVSYNYSGDGAGGSFPGLPDGADLVDSIIKGGPGDEWMQELDELFGNP

SEQ ID NO: 52682 - protein, 774 aa, Homo sapiens
MDDWKSRLVIKSMLPHFAMVGNRQEPRKLQESGKKPSWMEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQGCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATARGTEIRSYGNDP

SEQ ID NO: 52683 - protein, 136 aa, Homo sapiens
MDDWKSRLVIKSMLPHFAMVGNRQEPRKLQESGKKPSWMEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPM

SEQ ID NO: 52684 - protein, 774 aa, Homo sapiens; identical to SEQ ID NO: 52682

SEQ ID NO: 52685 - protein, 749 aa, Homo sapiens
MDDWKSRLVIKSMLPHFAMVGNRQEPRKLQESGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQGCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATARGTEIRSYGNDP

SEQ ID NO: 52686 - protein, 998 aa, Homo sapiens
MDDWKSRLVIKSMLPHFAMVGNRQEPRKLQESGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLIRSLTPTSNLLSQQQQQQQQQQQANVIFKPISSNSSKTLSMIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQQEEQRSGLMAMTPERQNAYISQQMSPFEAVQEQVTSKCSRIKASPPSSKHLMPPRTGLLQNNLSPGMIPLTRHQSCEGMGVISPTLGKRQGIFTSSPQCPILSHSGQTPLGRLDSVCQHMQSPKATPPEVPLPGFCPSSLGTQSLSPHQLRRPSVPRMPTAFNNAAWVTAAAAVTTAVSGKTPLSQVDNSVQQHSPSGQACLQRPSDWEAQVPAAMGTQVPLANNPSFSLLGSQSLRQSPVQGPVPVANTTKFLQQGMASFSPLSPIQGIEPPSYVAAAATAAAASAVAASQFPGPFDRTDIPPELPPADFLRQPQPPLNDLISSPDCNEVDFIEALLKGSCVSPDEDWVCNLRLIDDILEQHAAAQNATAQNSGQVTQDAGAL

SEQ ID NO: 52687 - protein, 646 aa, Homo sapiens
MEEEDLSFLYKSSPGRKHQGTVKRRQEEDHFQFPDMADGGYPNKIKRPCLEDVTLAMGPGAHPSTACAELQVPPLTINPSPAAMGVAGQSLLLENNPMNGNIMGSPFVVPQTTEVGLKGPTVPYYEKINSVPAVDQELQELLEELTKIQDPSPNELDLEKILGTKPEEPLVLDHPQATLSTTPKPSVQMSHLESLASSKEFASSCSQVTGMSLQIPSSSTGISYSIPSTSKQIVSPSSSMAQSKSQVQAMLPVALPPLPVPQWHHAHQLKALAASKQGSATKQQGPTPSWSGLPPPGLSPPYRPVPSPHPPPLPLPPPPPPFSPQSLMVSCMSSNTLSGSTLRGSPNALLSSMTSSSNAALGPAMPYAPEKLPSPALTQQPQFGPQSSILANLMSSTIKTPQGHLMSALPASNPGPSPPYRPEKLSSPGLPQQSFTPQCSLLHYLQQPTPTQASSATASSTATATLQLQQQQQQQQQQPDHSSFLLQQMMQQPQRFQRSVASDSMPALPRQGCCHLFAWTSAASSVKPQHQHGNSFTSRQDPQPGDVSPSNITHVDKACKLGEARHPQVSLGRQPPSCQALGSESFLPGSSFAHELARVTSSYSTSEAAPWGSWDPKAWRQVPAPLLPSCDATARGTEIRSYGNDP

SEQ ID NO: 52688 - protein, 214 aa, Homo sapiens
MIMQQGMASSSPGATEPFTFGNTKPLSHFVSEPGPQKMPSMPTTSRQPSLLHYLQQPTPTQASSATASSTATATLQLQQQQQQQQQQPDHSSFLLQQMMQQPQRFQRSVASDSMPALPRQTHVDKACKLGEARHPQVSLGRQPPSCQALGSESFLPGSSFAHELARVTSSYSTSEAAPWGSWDPKAWRQVPAPLLPSCDATARGTEIRSYGNDP

SEQ ID NO: 52689 - protein, 651 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52690 - protein, 580 aa, Homo sapiens
MMNFSNIMNYMKLLGQYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52691 - protein, 603 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52692 - protein, 520 aa, Homo sapiens
MVLEENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52693 - protein, 457 aa, Homo sapiens
MGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52694 - protein, 610 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52695 - protein, 619 aa, Homo sapiens
MMNFSNIMNYMKLLGQSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52696 - protein, 580 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 52697 - protein, 496 aa, Homo sapiens
MRVLSGTSLMLCSLLLLLQALCSPGLAPQSRGHLCRTRPTDLVFVVDSSRSVRPVEFEKVKVFLSQVIESLDVGPNATRVGMVNYASTVKQEFSLRAHVSKAALLQAVRRIQPLSTGTMTGLAIQFAITKAFGDAEGGRSRSPDISKVVIVVTDGRPQDSVQDVSARARASGVELFAIGVGSVDKATLRQIASEPQDEHVDYVESYSVIEKLSRKFQEAFCVVSDLCATGDHDCEQVCISSPGSYTCACHEGFTLNSDGKTCNVCSGGGGSSATDLVFLIDGSKSVRPENFELVKKFISQIVDTLDVSDKLAQVGLVQYSSSVRQEFPLGRFHTKKDIKAAVRNMSYMEKGTMTGAALKYLIDNSFTVSSGARPGAQKVGIVFTDGRSQDYINDAAKKAKDLGFKMFAVGVGNAVEDELREIASEPVAEHYFYTADFKTINQIGKKLQKKICVEEDPCACESLVKFQAKVEGLLQALTRKLEAVSKRLAILENTVV

SEQ ID NO: 52698 - protein, 957 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLLEEMTQRMEALENRLRYR

SEQ ID NO: 52699 - protein, 917 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRYLLEEMTQRMEALENRLRYR

SEQ ID NO: 52700 - protein, 115 aa, Homo sapiens
MEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKT

SEQ ID NO: 52701 - protein, 956 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 52702 - protein, 937 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTVQHRYLFEEDNLLRSTQKLSHSTKPSGSPLEEKHDQCKCENLIMFQNLANEEVRKLTQRLEEMTQRMEALENRLRYR

SEQ ID NO: 52703 - protein, 672 aa, Homo sapiens
MEDHNCEQLCVNVPGSFVCQCYSGYALAEDGKRCVAVDYCASENHGCEHECVNADGSYLCQCHEGFALNPDKKTCTKIDYCASSNHGCQHECVNTDDSYSCHCLKGFTLNPDKKTCRRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 52704 - protein, 915 aa, Homo sapiens
MEKMLAGCFLLILGQIVLLPAEARERSRGRSISRGRHARTHPQTALLESSCENKRADLVFIIDSSRSVNTHDYAKVKEFIVDILQFLDIGPDVTRVGLLQYGSTVKNEFSLKTFKRKSEVERAVKRMRHLSTGTMTGLAIQYALNIAFSEAEGARPLRENVPRVIMIVTDGRPQDSVAEVAAKARDTGILIFAIGVGQVDFNTLKSIGSEPHEDHVFLVANFSQIETLTSVFQKKLCTAHMCSTLEHNCAHFCINIPGSYVCRCKQGYILNSDQTTCRIQDLCAMEDHNCEQLCVNVPGSFVCQCYSGYALAEDGKRCVAVDYCASENHGCEHECVNADGSYLCQCHEGFALNPDKKTCTRINYCALNKPGCEHECVNMEESYYCRCHRGYTLDPNGKTCSRVDHCAQQDHGCEQLCLNTEDSFVCQCSEGFLINEDLKTCSRVDYCLLSDHGCEYSCVNMDRSFACQCPEGHVLRSDGKTCAKLDSCALGDHGCEHSCVSSEDSFVCQCFEGYILREDGKTCRRKDVCQAIDHGCEHICVNSDDSYTCECLEGFRLAEDGKRCRRKDVCKSTHHGCEHICVNNGNSYICKCSEGFVLAEDGRRCKKCTEGPIDLVFVIDGSKSLGEENFEVVKQFVTGIIDSLTISPKAARVGLLQYSTQVHTEFTLRNFNSAKDMKKAVAHMKYMGKGSMTGLALKHMFERSFTQGEGARPLSTRVPRAAIVFTDGRAQDDVSEWASKAKANGITMYAVGVGKAIEEELQEIASEPTNKHLFYAEDFSTMDEISEKLKKGICEALEDSDGRQDSPAGELPKTVQQPTESEPVTINIQDLLSCSNFAVQHRYLFEEDNLLRSTQKLSHSTKPSGSPLEEKHDQCKCENLIMFQNLANEEVRKLTQRLEEMTQRMEALENRLRYR

SEQ ID NO: 52705 - protein, 486 aa, Homo sapiens
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDPCVLGTHQCQHVCISDGEGKHHCECSQGYTLNADKKTCSALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 52706 - protein, 444 aa, Homo sapiens
MPRPAPARRLPGLLLLLWPLLLLPSAAPDPVARPGFRRLETRGPGGSPGRRPSPAAPDGAPASGTSEPGRARGAGVCKSRPLDLVFIIDSSRSVRPLEFTKVKTFVSRIIDTLDIGPADTRVAVVNYASTVKIEFQLQAYTDKQSLKQAVGRITPLSTGTMSGLAIQTAMDEAFTVEAGAREPSSNIPKVAIIVTDGRPQDQVNEVAARAQASGIELYAVGVDRADMASLKMMASEPLEEHVFYVETYGVIEKLSSRFQETFCALDRCALNTHGCEHICVNDRSGSYHCECYEGYTLNEDRKTCSAQDKCALGTHGCQHICVNDRTGSHHCECYEGYTLNADKKTCSVRDKCALGSHGCQHICVSDGAASYHCDCYPGYTLNEDKKTCSATEEARRLVSTEDACGCEATLAFQDKVSSYLQRLNTKLDDILEKLKINEYGQIHR

SEQ ID NO: 52707 - protein, 622 aa, Homo sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCGKDQCAEGGHGCQHQCVNAWAMFHCTCNPGYKLAADNKSCLAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 52708 - protein, 581 aa, Homo sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 52709 - protein, 499 aa, Homo sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 52710 - protein, 540 aa, Homo sapiens
MRGLLCWPVLLLLLQPWETQLQLTGPRCHTGPLDLVFVIDSSRSVRPFEFETMRQFLMGLLRGLNVGPNATRVGVIQYSSQVQSVFPLRAFSRREDMERAIRDLVPLAQGTMTGLAIQYAMNVAFSVAEGARPPEERVPRVAVIVTDGRPQDRVAEVAAQARARGIEIYAVGVQRADVGSLRAMASPPLDEHVFLVESFDLIQEFGLQFQSRLCAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 52711 - protein, 432 aa, Homo sapiens
MRGLLCWPVLLLLLQPWETQLQLTGKDQCAEGGHGCQHQCVNAWAMFHCTCNPGYKLAADNKSCLAIDLCAEGTHGCEHHCVNSPGSYFCHCQVGFVLQQDQRSCRAIDYCSFGNHSCQHECVSTPGGPRCHCREGHDLQPDGRSCQVRDLCNGVDHGCEFQCVSEGLSYRCLCPEGRQLQADGKSCNRCREGHVDLVLLVDGSKSVRPQNFELVKRFVNQIVDFLDVSPEGTRVGLVQFSSRVRTEFPLGRYGTAAEVKQAVLAVEYMERGTMTGLALRHMVEHSFSEAQGARPRALNVPRVGLVFTDGRSQDDISVWAARAKEEGIVMYAVGVGKAVEAELREIASEPAELHVSYAPDFGTMTHLLENLRGSICPEEGISAGTELRSPCECESLVEFQGRTLGALESLTLNLAQLTARLEDLENQLANQK

SEQ ID NO: 52712 - protein, 432 aa, Homo sapiens; identical to SEQ ID NO: 52711

SEQ ID NO: 52713 - protein, 622 aa, Homo sapiens; identical to SEQ ID NO: 52707

SEQ ID NO: 52714 - protein, 581 aa, Homo sapiens; identical to SEQ ID NO: 52708

SEQ ID NO: 52715 - protein, 283 aa, Homo sapiens
MSKSFQQSSLSRDSQGHGRDLSAAGIGLLAAATQSLSMLLESEDELLVDEEEAAALLESGSSVGDETDLANLGDVASDGKKEPSDKAVKKDGSASAAAKKKLKKRRFPGSMEGFVTLDEVGDEEDSELQKLRKSGMAFKSGDKNDDGLVEIKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 52716 - protein, 847 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 52717 - protein, 847 aa, Homo sapiens; identical to SEQ ID NO: 52716

SEQ ID NO: 52718 - protein, 99 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSS

SEQ ID NO: 52719 - protein, 509 aa, Homo sapiens
MGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 52720 - protein, 87 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIF

SEQ ID NO: 52721 - protein, 559 aa, Homo sapiens
MLGAQWRRNQPSRAAEEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNKINEAFIEMATTEDAQAAVDYYTTTPALVFGKPVRVHLSQKYKRIKKPEGKPDQKFDQKQELGRVIHLSNLPHSGYSDSAVLKLAEPYGKIKNYILMRMKSQAFIEMETREDAMAMVDHCLKKALWFQGRCVKVDLSEKYKKLVLRIPNRGIDLLKKDKSRKRSYSPDGKESPSDKKSKTDGSQKTESSTEGKEQEEKSGEDGEKDTKDDQTEQEPNMLLESEDELLVDEEEAAALLESGSSVGDETDLANLGDVASDGKKEPSDKAVKKDGSASAAAKKKLKKVDKIEELDQENEAALENGIKNEENTEPGAESSENADDPNKDTSENADGQSDENKDDYTIPDEYRIGPYQPNVPVGIDYVIPKTGFYCKLCSLFYTNEEVAKNTHCSSLPHYQKLKKFLNKLAEERRQKKET

SEQ ID NO: 52722 - protein, 78 aa, Homo sapiens
MSKSFQQSSLSRDSQGHGRDLSAAGIGLLAAATQSLSMPASLGRMNQGTARLASLMNLGMSSSLNQQGAHSALSSAST

SEQ ID NO: 52723 - protein, 433 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQASNILASFGLSARDLDELSRYPEDKITPENLPQILLQLKRRRTEEGPTLSYGRDGRSATREPPYRVPRDDWEEKRHFRRDSFDDRGPSLNPVLDYDHGSRSQESGYYDRMDYEDDRLRDGERCRDDSFFGETSHNYHKFDSEYERMGRGPGPLQERSLFEKKRGAPPSSNIEDFHGLLPKGYPHLCSICDLPVHSNKEWSQHINGASHSRRCQLLLEIYPEWNPDNDTGHTMGDPFMLQQSTNPAPGILGPPPPSFHLGGPAVGPRGNLGAGNGNLQGPRHMQKGRVETSRVVHIMDFQRGKNLRYQLLQLVEPFGVISNHLILNK

SEQ ID NO: 52724 - protein, 509 aa, Homo sapiens; identical to SEQ ID NO: 52719

SEQ ID NO: 52725 - protein, 47 aa, Homo sapiens
MSKSFQQSSLSRDSQGHGRDLSAAGIGLLAAATQSLSMPASLGRMNQ

SEQ ID NO: 52726 - protein, 78 aa, Homo sapiens; identical to SEQ ID NO: 52722

SEQ ID NO: 52727 - protein, 847 aa, Homo sapiens; identical to SEQ ID NO: 52716

SEQ ID NO: 52728 - protein, 9 aa, Homo sapiens
MSKSFQQSS

SEQ ID NO: 52729 - protein, 100 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQ

SEQ ID NO: 52730 - protein, 107 aa, Homo sapiens
MSKSFQQSSLSRDSQGHGRDLSAAGIGLLAAATQSLSMPASLGRMNQGTARLASLMNLGMSSSLNQQGAHSALSSASTSSHNLQSIFNIGSRGPLPLSSQHRGDADQ

SEQ ID NO: 52731 - protein, 525 aa, Homo sapiens
MRVFCVGLLLFSVTWAAPTFQPQTEKTKQSCVEEQRQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 52732 - protein, 525 aa, Homo sapiens; identical to SEQ ID NO: 52731

SEQ ID NO: 52733 - protein, 275 aa, Homo sapiens
MRVFCVGLLLFSVTWAAPTFQPQTEKTKQSCVEEQRQEEKNKDNIGFHHLGKRINQELSSKENIVQERKKDLSLSEASENKGSSKSQNYFTNRQRLNKEYSISNKENTHNGLRMSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGTANLLRTFLVKEKLLVLT

SEQ ID NO: 52734 - protein, 412 aa, Homo sapiens
MSIYPKSTGNKGFEDGDDAISKLHDQEEYGAALIRNNMQHIMGPVTAIKLLGEENKENTPRNVLNIIPASMNYAKAHSKDKKKPQRDSQAQKSPVKSKSTHRIQHNIDYLKHLSKVKKIPSDFEGSGYTDLQERGDNDISPFSGDGQPFKDIPGKGEATGPDLEGKDIQTGFAGPSEAESTHLDTKKPGYNEIPEREENGGNTIGTRDETAKEADAVDVSLVEGSNDIMGSTNFKELPGREGNRVDAGSQNAHQGKVEFHYPPAPSKEKRKEGSSDAAESTNYNEIPKNGKGSTRKGVDHSNRNQATLNEKQRFPSKGKSQGLPIPSRGLDNEIKNEMDSFNGPSHENIITHGRKYHYVPHRQNNSTRNKGMPQGKGSWGRQPHSNRRFSSRRRDDSSESSDSGSSSESDGD

SEQ ID NO: 52735 - protein, 412 aa, Homo sapiens; identical to SEQ ID NO: 52734

SEQ ID NO: 52736 - protein, 103 aa, Homo sapiens
MKSLILLAILAALAVVTLCYESHESMESYELNPFINRRNANTFISPQQRWRAKVQERIRERSKPVHELNREACDDYRLCERYAMVYGYNAAYNRYFRKRRGTK

SEQ ID NO: 52737 - protein, 128 aa, Homo sapiens
MKSLILLAILAALAVVTLCYGEWQKEENFGFDIVSVLSLNWHRAQESHESMESYELNPFINRRNANTFISPQQRWRAKVQERIRERSKPVHELNREACDDYRLCERYAMVYGYNAAYNRYFRKRRGTK

SEQ ID NO: 52738 - protein, 582 aa, Homo sapiens
MSIETLLEAARFLEWQAQQQQRAREEQERLRLEQEREQEQKKANSLARLAHTLPVEEPRMEAPPLPLSPPAPPPAPPPPLATPAPLTVIPIPVVTNSPQPLPPPPPLPAAAQPLPLAPRQPALVGAPGLSIKEPAPLPSRPQVPTPAPLLPDSKATIPPNGSPKPLQPLPTPVLTIAPHPGVQPQLAPQQPPPPTLGTLKLAPAEEVKSSEQKKRPGGIGTREVHNKLEKNRRAHLKECFETLKRNIPNVDDKKTSNLSVLRTALRYIQSLKRKEKEYEHEMERLAREKIATQQRLAELKHELSQWMDVLEIDRVLRQTGQPEDDQASTSTASEGEDNIDEDMEEDRAGLGPPKLSHRPQPELLKSTLPPPSTTPAPLPPHPHPHPHSVALPPAHLPVQQQQPQQKTPLPAPPPPPAAPAQTLVPAPAHLVATAGGGSTVIAHTATTHASVIQTVNHVLQGPGGKHIAHIAPSAPSPAVQLAPATPPIGHITVHPATLNHVAHLGSQLPLYPQPVAVSHIAHTLSHQQVNGTAGLGPPATVMAKPAVGAQVVHHPQLVGQTVLNPVTMVTMPSFPVSTLKLA

SEQ ID NO: 52739 - protein, 582 aa, Homo sapiens; identical to SEQ ID NO: 52738

SEQ ID NO: 52740 - protein, 197 aa, Homo sapiens
MEPLASNIQVLLQAAEFLERREREAEHGYASLCPHRSPGPIHRRKKRPPQAPGAQDSGRWRAQLKRCLERLKQQMPLGADCARYTTLSLLRRARMHIQKLEDQEQRARQLKERLRSKQQSLQRQLEQLRGLAGAAERERLRADSLDSSGLSSERSDSDQEELEVDVESLVFGGEAELLRGFVAGQEHSYSHGGGAWL

SEQ ID NO: 52741 - protein, 388 aa, Homo sapiens
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQGECPEAEGLCGPRGEPGLLTGPLPAQRSWRWMWRAWCLGVRPSCCGASSPARSTATRTAAAPGYDVPHPGRASALYSCQAHLPGRSPPQAFRAARSHLLEWTKRTLVWEQVLPKHPAAGCQAGPLEGKGQDSSGPPWTPAGQAAWARAQAFGSAAPKGTGSLLGLFPSWTRPPAFASHKLYSIFIKSLFHNFPSIVLPNENGGTPNHRPTGRGNNISSHH

SEQ ID NO: 52742 - protein, 193 aa, Homo sapiens
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQVLPNENGGTPNHRPTGRGNNISSHH

SEQ ID NO: 52743 - protein, 206 aa, Homo sapiens
MEPLASNIQVLLQAAEFLERREREAEHGYASLCPHRSPGPIHRRKKRPPQAPGAQDSGRSVHNELEKRRRAQLKRCLERLKQQMPLGADCARYTTLSLLRRARMHIQKLEDQEQRARQLKERLRSKQQSLQRQLEQLRGLAGAAERERLRADSLDSSGLSSERSDSDQEELEVDVESLVFGGEAELLRGFVAGQEHSYSHGGGAWL

SEQ ID NO: 52744 - protein, 206 aa, Homo sapiens; identical to SEQ ID NO: 52743

SEQ ID NO: 52745 - protein, 3065 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 52746 - protein, 3026 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIAARPSPGGVFTQFVMSKVGALQQKIPGVSTPQTLAGTQKFSIRPSPVMVVTPVVSSEPVQVCSPVTAAVTTTTPQVFLENTTAVTPMTAISDVETKETTYSSGATTTGVVEVSETNTSTSVTSTQSTATVNLTKTTGITTPVASVAFPKSLVASPSTITLPVASTASTSLVVVTAAASSSMVTTPTSSLGSVPIILSGINGSPPVSQRPENAAQIPVATPQVSPNTVKRAGPRLLHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 52747 - protein, 2856 aa, Homo sapiens
MEEKQQIILANQDGGTVAGAAPTFFVILKQPGNGKTDQGILVTNQDACALASSVSSPVKSKGKICLPADCTVGGITVTLDNNSMWNEFYHRSTEMILTKQGRRMFPYCRYWITGLDSNLKYILVMDISPVDNHRYKWNGRWWEPSGKAEPHVLGRVFIHPESPSTGHYWMHQPVSFYKLKLTNNTLDQEGHIILHSMHRYLPRLHLVPAEKAVEVIQLNGPGVHTFTFPQTEFFAVTAYQNIQITQLKIDYNPFAKGFRDDGLNNKPQRDGKQKNSSDQEGNNISSSSGHRVRLTEGQGSEIQPGDLDPLSRGHETSGKGLEKTSLNIKRDFLGFMDTDSALSEVPQLKQEISECLIASSFEDDSRVASPLDQNGSFNVVIKEEPLDDYDYELGECPEGVTVKQEETDEETDVYSNSDDDPILEKQLKRHNKVDNPEADHLSSKWLPSSPSGVAKAKMFKLDTGKMPVVYLEPCAVTRSTVKISELPDNMLSTSRKDKSSMLAELEYLPTYIENSNETAFCLGKESENGLRKHSPDLRVVQKYPLLKEPQWKYPDISDSISTERILDDSKDSVGDSLSGKEDLGRKRTTMLKIATAAKVVNANQNASPNVPGKRGRPRKLKLCKAGRPPKNTGKSLISTKNTPVSPGSTFPDVKPDLEDVDGVLFVSFESKEALDIHAVDGTTEESSSLQASTTNDSGYRARISQLEKELIEDLKTLRHKQVIHPGLQEVGLKLNSVDPTMSIDLKYLGVQLPLAPATSFPFWNLTGTNPASPDAGFPFVSRTGKTNDFTKIKGWRGKFHSASASRNEGGNSESSLKNRSAFCSDKLDEYLENEGKLMETSMGFSSNAPTSPVVYQLPTKSTSYVRTLDSVLKKQSTISPSTSYSLKPHSVPPVSRKAKSQNRQATFSGRTKSSYKSILPYPVSPKQKYSHVILGDKVTKNSSGIISENQANNFVVPTLDENIFPKQISLRQAQQQQQQQQGSRPPGLSKSQVKLMDLEDCALWEGKPRTYITEERADVSLTTLLTAQASLKTKPIHTIIRKRAPPCNNDFCRLGCVCSSLALEKRQPAHCRRPDCMFGCTCLKRKVVLVKGGSKTKHFQRKAAHRDPVFYDTLGEEAREEEEGIREEEEQLKEKKKRKKLEYTICETEPEQPVRHYPLWVKVEGEVDPEPVYIPTPSVIEPMKPLLLPQPEVLSPTVKGKLLTGIKSPRSYTPKPNPVIREEDKDPVYLYFESMMTCARVRVYERKKEDQRQPSSSSSPSPSFQQQTSCHSSPENHNNAKEPDSEQQPLKQLTCDLEDDSDKLQEKSWKSSCNEGESSSTSYMHQRSPGGPTKLIEIISDCNWEEDRNKILSILSQHINSNMPQSLKVGSFIIELASQRKSRGEKNPPVYSSRVKISMPSCQDQDDMAEKSGSETPDGPLSPGKMEDISPVQTDALDSVRERLHGGKGLPFYAGLSPAGKLVAYKRKPSSSTSGLIQVASNAKVAASRKPRTLLPSTSNSKMASSSGTATNRPGKNLKAFVPAKRPIENAAQIPVATPQVSPNTVKRAGPRLLLIPVQQGSPTLRPVSNTQLQGHRMVLQPVRSPSGMNLFRHPNGQIVQLLPLHQLRGSNTQPNLQPVMFRNPGSVMGIRLPAPSKPSETPPSSTSSSAFSVMNPVIQAVGSSSAVNVITQAPSLLSSGASFVSQAGTLTLRISPPEPQSFASKTGSETKITYSSGGQPVGTASLIPLQSGSFALLQLPGQKPVPSSILQHVASLQMKRESQNPDQKDETNSIKREQETKKVLQSEGEAVDPEANVIKQNSGAATSEETLNDSLEDRGDHLDEECLPEEGCATVKPSEHSCITGSHTDQDYKDVNEEYGARNRKSSKEKVAVLEVRTISEKASNKTVQNLSKVQHQKLGDVKVEQQKGFDNPEENSSEFPVTFKEESKFELSGSKVMEQQSNLQPEAKEKECGDSLEKDRERWRKHLKGPLTRKCVGASQECKKEADEQLIKETKTCQENSDVFQQEQGISDLLGKSGITEDARVLKTECDSWSRISNPSAFSIVPRRAAKSSRGNGHFQGHLLLPGEQIQPKQEKKGGRSSADFTVLDLEEDDEDDNEKTDDSIDEIVDVVSDYQSEEVDDVEKNNCVEYIEDDEEHVDIETVEELSEEINVAHLKTTAAHTQSFKQPSCTHISADEKAAERSRKAPPIPLKLKPDYWSDKLQKEAEAFAYYRRTHTANERRRRGEMRDLFEKLKITLGLLHSSKVSKSLILTRAFSEIQGLTDQADKLIGQKNLLTRKRNILIRKVSSLSGKTEEVVLKKLEYIYAKQQALEAQKRKKKMGSDEFDISPRISKQQEGSSASSVDLGQMFINNRRGKPLILSRKKDQATENTSPLNTPHTSANLVMTPQGQLLTLKGPLFSGPVVAVSPDLLESDLKPQVAGSAVALPENDDLFMMPRIVNVTSLATEGGLVDMGGSKYPHEVPDSKPSDHLKDTVRNEDNSLEDKGRISSRGNRDGRVTLGPTQVFLANKDSGYPQIVDVSNMQKAQEFLPKKISGDMRGIQYKWKESESRGERVKSKDSSFHKLKMKDLKDSSIEMELRKVTSAIEEAALDSSELLTNMEDEDDTDETLTSLLNEIAFLNQQLNDDSVGLAELPSSMDTEFPGDARRAFISKVPPGSRATFQVEHLGTGLKELPDVQGESDSISPLLLHLEDDDFSENEKQLAEPASEPDVLKIVIDSEIKDSLLSNKKAIDGGKNTSGLPAEPESVSSPPTLHMKTGLENSNSTDTLWRPMPKLAPLGLKVANPSSDADGQSLKVMPCLAPIAAKVGSVGHKMNLTGNDQEGRESKVMPTLAPVVAKLGNSGASPSSAGK

SEQ ID NO: 52748 - protein, 228 aa, Homo sapiens
MERVKMINVQRLLEAAEFLERRERECEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 52749 - protein, 295 aa, Homo sapiens
MGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 52750 - protein, 182 aa, Homo sapiens
MPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 52751 - protein, 192 aa, Homo sapiens
MPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 52752 - protein, 192 aa, Homo sapiens; identical to SEQ ID NO: 52751

SEQ ID NO: 52753 - protein, 192 aa, Homo sapiens; identical to SEQ ID NO: 52751

SEQ ID NO: 52754 - protein, 218 aa, Homo sapiens
MERVKMINVQRLLEAAEFLERRERECEHGYASSFPSMPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDRSDSEREEIEVDVESTEFSHGEVDNISTTSISDIDDHSSLPSIGSDEGYSSASVKLSFTS

SEQ ID NO: 52755 - protein, 218 aa, Homo sapiens; identical to SEQ ID NO: 52754

SEQ ID NO: 52756 - protein, 118 aa, Homo sapiens
MPSPRLQHSKPPRRLSRAQKHSSGSSNTSTANRSTHNELEKNRRAHLRLCLERLKVLIPLGPDCTRHTTLGLLNKAKAHIKKLEEAERKSQHQLENLEREQRFLKWRLEQLQGPQEME

SEQ ID NO: 52757 - protein, 226 aa, Homo sapiens
MGKRGRPRKEARCEGAGLAPAAPPAVPPAVAAPQPPALPEDPAGAKPRCPFSDIFNTSENSMEKHINTFLQNVQILLEAASYLEQIEKENKKCEHGYASSFPSMPSPRLQHSKPPRRLSRAQKHSSGSSNTSTANRRAHLRLCLERLKVLIPLGPDCTRHTTLGLLNKAKAHIKKLEEAERKSQHQLENLEREQRFLKWRLEQLQGPQEMERIRMDSIGSTISSDR

SEQ ID NO: 52758 - protein, 298 aa, Homo sapiens
MTEPGASPEDPWVKASPVGAHAGEGRAGRARARRGAGRRGASLLSPKSPTLSVPRGCREDSSHPACAKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 52759 - protein, 214 aa, Homo sapiens
MTEPGASPEDPWVKVEYAYSDNSLDPDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 52760 - protein, 244 aa, Homo sapiens
MTEPGASPEDPWVKVEYAYSDNSLDPGLFVESTRKGSVVSRANSIGSTSASSVPNTDDEDSDYHQEAYKESYKDRRRRAHTQAEQKRRDAIKRGYDDLQTIVPTCQQQDFSIGSQKLSKAIVLQKTIDYIQFLHKEKKKQEEEVSTLRKDVTALKIMKVNYEQIVKAHQDNPHEGEDQVSDQVKFNVFQGIMDSLFQSFNASISVASFQELSACVFSWIEEHCKPQTLREIVIGVLHQLKNQLY

SEQ ID NO: 52761 - protein, 941 aa, Homo sapiens
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQVGVGYSFFQACKLFSKGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 52762 - protein, 860 aa, Homo sapiens
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEDLCRRWLSYIDEATMSNGK

SEQ ID NO: 52763 - protein, 925 aa, Homo sapiens
MAEANPRRGKMRFRRNAASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 52764 - protein, 1070 aa, Homo sapiens
MPQAAASAPWTSVSCGRIPGLPQNPDGCTFMPIAQAIPLQVDMAMALQRVRIAEKYGKNYLCLLQAVFVAETDLLLRIKDISHFLMQDIAFLSGGRGKDNAWIITFPENCNFRCIPEEVIAKVLTYLTSIARQNGSDSRFTIILDRRLDTWSSLKISLQKISASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 52765 - protein, 985 aa, Homo sapiens
MQDIAFLSGGRGKDNAWIITFPENCNFRCIPEEVIAKVLTYLTSIARQNGSDSRFTIILDRRLDTWSSLKISLQKISASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 52766 - protein, 429 aa, Homo sapiens
  MOD_RES (1)..(1): Any amino acid
XHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 52767 - protein, 528 aa, Homo sapiens
VQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 52768 - protein, 1001 aa, Homo sapiens
MQDIAFLSGGRGKDNAWIITFPENCNFRCIPEEVIAKVLTYLTSIARQNGSDSRFTIILDRRLDTWSSLKISLQKISASFPGNLHLVLVLRPTSFLQRTFTDIGFWFSQEDFMLKLPVVMLSSVSDLLTYIDDKQLTPELGGTLQYCHSEWIIFRNAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQVGVGYSFFQACKLFSKGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEKQQGAFISTEETELEHTSTVVEVCEAIASVQAEANTVWTEASQSAEISEEPAEWSSNYFYPTYDENEEENRPLMRPVSEMALLY

SEQ ID NO: 52769 - protein, 985 aa, Homo sapiens; identical to SEQ ID NO: 52765

SEQ ID NO: 52770 - protein, 821 aa, Homo sapiens
MAEANPRRGKMRFRRNAASFPGNLHLVLVLRPTSFLQRTFTDIGFWFSQEDFMLKLPAIENFALTVKEMAQMLQSFGTELAETELPDDIPSIEEILAIRAERYHLLKNDITAVTKEGKILLTNLEVPDTEGAVSSRLECHRQISGDWQTINKLLTQVHDMETAFDGFWEKHQLKMEQYLQLWKFEQDFQQLVTEVEFLLNQQAELADVTGTIAQVKQKIKKLENLDENSQELLSKAQFVILHGHKLAANHHYALDLICQRCNELRYLSDILVNEIKAKRIQLSRTFKMHKLLQQARQCCDEGECLLANQEIDKFQSKEDAQKALQDIENFLEMALPFINYEPETLQYEFDVILSPELKVQMKTIQLKLENIRSIFENQQAGFRNLADKHVRPIQFVVPTPENLVTSGTPFFSSKQGKKTWRQNQSNLKIEVVPDCQEKRSSGPSSSLDNGNSLDVLKNHVLNELIQTERVYVRELYTVLLGYRAEMDNPEMFDLMPPLLRNKKDILFGNMAEIYEFHNDIFLSSLENCAHAPERVGPCFLERKDDFQMYAKYCQNKPRSETIWRKYSECAFFQECQRKLKHRLRLDSYLLKPVQRITKYQLLLKELLKYSKDCEGSALLKKALDAMLDLLKSVNDSMHQIAINGYIGNLNELGKMIMQGGFSVWIGHKKGATKMKDLARFKPMQRHLFLYEKAIVFCKRRVESGEGSDRYPSYSFKHCWKMDEVGITEYVKGDNRKFEIWYGEKEEVYIVQASNVDVKMTWLKEIRNILLKQQELLTVKKRKQQDQLTERDKFQISLQQNDEDLCRRWLSYIDEATMSNGK

SEQ ID NO: 52771 - protein, 984 aa, Homo sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKEP

SEQ ID NO: 52772 - protein, 1129 aa, Homo sapiens
MAEKGASRGTLRRLWSLPRRRRGTAGRSRPDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 52773 - protein, 1182 aa, Homo sapiens
MARVESPVPAARASLTGSCVLGQAMPLRGGAGPSPASHGPTHGPSDPRTCLPGRGAGGMRPHGRGALGCCGLCSFYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 52774 - protein, 1137 aa, Homo sapiens
MFDCWRFILCKRPGSNSYSSPQRPNEAKKEETDHQIDVSDVIRLVQDTPEATAMATDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 52775 - protein, 793 aa, Homo sapiens
  MOD_RES (1)..(1): Any amino acid
XSQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKASPTSPDKKAKRHEVKSDPTPFGVRGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 52776 - protein, 1096 aa, Homo sapiens
MPLRGGAGPSPASHGPTHGPSDPRTCLPGRGAGGMRPHGRGALGCCGLCSFYTCHGAAGDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLW

SEQ ID NO: 52777 - protein, 136 aa, Homo sapiens
MHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVI

SEQ ID NO: 52778 - protein, 1123 aa, Homo sapiens
MTVRRLSLLCRDLWALWLLLKAGADEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 52779 - protein, 246 aa, Homo sapiens
MRFWLRTEEMALEEMVQRLNAVSKHTDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTE

SEQ ID NO: 52780 - protein, 1113 aa, Homo sapiens
MGDGKAVRISVAEMKSYYLYSEWCSWLLSVAEDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSGKAHVPRAHP

SEQ ID NO: 52781 - protein, 903 aa, Homo sapiens
LKMPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGL

SEQ ID NO: 52782 - protein, 1137 aa, Homo sapiens; identical to SEQ ID NO: 52774

SEQ ID NO: 52783 - protein, 1125 aa, Homo sapiens
MRFWLRTEEMALEEMVQRLNAVSKHTDEIMHQDIVPLCAADIQDQLKKRFAYLSGGRGQDGSPVITFPDYPAFSEIPDKEFQNVMTYLTSIPSLQDAGIGFILVIDRRRDKWTSVKASVLRIAASFPANLQLVLVLRPTGFFQRTLSDIAFKFNRDDFKMKVPVIMLSSVPDLHGYIDKSQLTEDLGGTLDYCHSRWLCQRTAIESFALMVKQTAQMLQSFGTELAETELPNDVQSTSSVLCAHTEKKDKAKEDLRLALKEGHSVLESLRELQAEGSEPSVNQDQLDNQATVQRLLAQLNETEAAFDEFWAKHQQKLEQCLQLRHFEQGFREVKAILDAASQKIATFTDIGNSLAHVEHLLRDLASFEEKSGVAVERARALSLDGEQLIGNKHYAVDSIRPKCQELRHLCDQFSAEIARRRGLLSKSLELHRRLETSMKWCDEGIYLLASQPVDKCQSQDGAEAALQEIEKFLETGAENKIQELNAIYKEYESILNQDLMEHVRKVFQKQASMEEVFHRRQASLKKLAARQTRPVQPVAPRPEALAKSPCPSPGIRRGSENSSSEGGALRRGPYRRAKSEMSESRQGRGSAGEEEESLAILRRHVMSELLDTERAYVEELLCVLEGYAAEMDNPLMAHLLSTGLHNKKDVLFGNMEEIYHFHNRIFLRELENYTDCPELVGRCFLERMEDFQIYEKYCQNKPRSESLWRQCSDCPFFQECQRKLDHKLSLDSYLLKPVQRITKYQLLLKEMLKYSRNCEGAEDLQEALSSILGILKAVNDSMHLIAITGYDGNLGDLGKLLMQGSFSVWTDHKRGHTKVKELARFKPMQRHLFLHEKAVLFCKKREENGEGYEKAPSYSYKQSLNMAAVGITENVKGDAKKFEIWYNAREEVYIVQAPTPEIKAAWVNEIRKVLTSQLQACREASQHRALEQSQSLPLPAPTSTSPSRGNSRNIKKLEERKTDPLSLEGYVSSAPLTKPPEKGKGWSKTSHSLEAPEDDGGWSSAEEQINSSDAEEDGGLGPKKLVPGKYTVVADHEKGGPDALRVRSGDVVELVQEGDEGLWYVRDPTTGKEGWVPASSLSVRLGPSGSAQCLSSSESSPGSAVLSNSSSCSEGGQAPFSDLQG

SEQ ID NO: 52784 - protein, 570 aa, Homo sapiens
MSRLEAKKPSLCKSEPLTTERVRTTLSVLKRIVTSCYGPSGRLKQLHNGFGGYVCTTSQSSALLSHLLVTHPILKILTASIQNHVSSFSDCGLFTAILCCNLIENVQRLGLTPTTVIRLNKHLLSLCISYLKSETCGCRIPVDFSSTQILLCLVRSILTSKPACMLTRKETEHVSALILRAFLLTIPENAEGHIILGKSLIVPLKGQRVIDSTVLPGILIEMSEVQLMRLLPIKKSTALKVALFCTTLSGDTSDTGEGTVVVSYGVSLENAVLDQLLNLGRQLISDHVDLVLCQKVIHPSLKQFLNMHRIIAIDRIGVTLMEPLTKMTGTQPIGSLGSICPNSYGSVKDVCTAKFGSKHFFHLIPNEATICSLLLCNRNDTAWDELKLTCQTALHVLQLTLKEPWALLGGGCTETHLAAYIRHKTHNDPESILKDDECTQTELQLIAEAFCSALESVVGSLEHDGGEILTDMKYGHLWSVQADSPCVANWPDLLSQCGCGLYNSQEELNWSFLRSTRRPFVPQSCLPHEAVGSASNLTLDCLTAKLSGLQVAVETANLILDLSYVIEDKN

SEQ ID NO: 52785 - protein, 570 aa, Homo sapiens; identical to SEQ ID NO: 52784

SEQ ID NO: 52786 - protein, 714 aa, Homo sapiens
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGLDRLLRKKAGLTVVPSYNALRNSEYQRQFVWKTSKETAPAFAANQVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVREKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 52787 - protein, 69 aa, Homo sapiens
MPVRFKGLSEYQRNFLWKKSYLSESCNSSVGRKYPWAGLRSDQLGNQGRCRTKIQHSDISSLLILVCST

SEQ ID NO: 52788 - protein, 222 aa, Homo sapiens
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGVGIFTAFLFKSIEFFIGFIVISVILHFVFQNFPLLFSCLMSIRIVDNRLLTLVIVN

SEQ ID NO: 52789 - protein, 679 aa, Homo sapiens
MPVRFKGLSEYQRNFLWKKSYLSESCNSSVGRKYPWAGLRSDQLGITKEPSFISKRRVPYHDPQISKSLEWNGAISESNVVASPEPEAPETPKSQEAEQKDVTQERVHSLEASRVPKRTRSHSADSRAEGASDVENNEGVTNHTPVNENVELEHSTKVLSENVDNGVFHNKSQFVPPFKGNSVIHETEYKRNFKGLSPVKEPKLRNDLRENRNLETVSPERKSNKIDDRLKLEAEMELKDLHQPKRKLTPWKHQRLGKVNSEYRAKFLSPAQYLYKAGAWTHVKGNMPNQGSLNAMWYAEVKELREKAEFYRKRVQGTHFSRDHLNQILSDSNCCWDVSSTTSSEGTVSSNIRALDLAGDPTSHKTLQKCPSTEPEEKGNIVEEQPQKNTTEKLGVSAPTIPVRRRLAWDTENTSEDVQKQPGEKEEEDDNEEEGDRKTGKQAFMGEQEKLDVREKSKADKMKEGSDSSVSSEKGGRLPTPKLRELGGIQRTHHDLTTPAVGGAVLVSPSKMKPPAPEQRKRMTSQDCLETSKNDFTKKESRAVSLLTSPAAGIKTVDPLPLREDSEDNIHKFAEATLPVSKIPKYPTNPPGQLPSPPHVPSYWHPSRRIQGSLRDPEFQHNVGKARMNNLQLPQHEAFNDEDEDRLSEISARSAASSLRAFQTLARAKKRKENFWGKT

SEQ ID NO: 52790 - protein, 904 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKHLREWYSAKITIAGNHCEINCQKIAEYLSANVVSLEDLRNVIDSKELWRGKIQIWERKFGFEISFPEFCLKGVTLKNFSTSNLNTDFLAKKIIPSKDKNILPKVFHYYGPALEFVQMIKLSDLPSCYMSDIEFELGLTNSTKQNSVLLLEQISSLCSKVGALFVLPCTISNILIPPPNQLSSRKWKEYIAKKPKTISVPDVEVKGECSSYYLLLQGNGNRRCKATLIHSANQINGSFALNLIHGKMKTKTEEAKLSFPFDLLSLPHFSGEQIVQREKQLANVQVLALEECLKRRKLAKQPETVSVAELKSLLVLTRKHFLDYFDAVIPKMILRKMDKIKTFNILNDFSPVEPNSSSLMETNPLEWPERHVLQNLETFEKTKQKMRTGSLPHSSEQLLGHKEGPRDSITLLDAKELLKYFTSDGLPIGDLQPLPIQKGEKTFVLTPELSPGKLQVLPFEKASVCHYHGIEYCLDDRKALERDGGFSELQSRLIRYETQTTCTRESFPVPTVLSPLPSPVVSSDPGSVPDGEVLQNELRTEVSRLKRRSKDLNCLYPRKRLVKSESSESLLSQTTGNSNHYHHHVTSRKPQTERSLPVTCPLVPIPSCETPKLATKTSSGQKSMHESKTSRQIKESRSQKHTRILKEVVTETLKKHSITETHECFTACSQRLFEISKFYLKDLKTSRGLFEEMKKTANNNAVQVIDWVLEKTSKK

SEQ ID NO: 52791 - protein, 457 aa, Homo sapiens
  MOD_RES (1)..(1): Any amino acid
XMAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGPSWNRAPFRKGCGVCWTVWKGSASRVPFTMC

SEQ ID NO: 52792 - protein, 521 aa, Homo sapiens
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKALLSSSKTKEGRKVDGERVLNPQPVSLSLFPGKPHSTAWGLLRLRYELFLSK

SEQ ID NO: 52793 - protein, 559 aa, Homo sapiens
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 52794 - protein, 520 aa, Homo sapiens
MAETVWSTDTGEAVYRSRDPVRNLRLRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGLSSSKTKEGRKVDGERVLNPQPVSLSLFPGKPHSTAWGLLRLRYELFLSK

SEQ ID NO: 52795 - protein, 549 aa, Homo sapiens
MAVPVSSFAQRTRSRFRVHLQRITSSNFLHYQPAAELGKDLIDLATFRPQPTASGHRPEEDEEEEIVIGWQEKLFSQFEVDLYQNETACQSPLDYQYRQEILKLENSGGKKNRRIFTYTDSDRYTNLEEHCQRMTTAASEVPSFLVERMANVRRRRQDRRGMEGGILKSRIVTWEPSEEFVRNNHVINTPLQTMHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 52796 - protein, 356 aa, Homo sapiens
MHIMADLGPYKKLGYKKYEHVLCTLKVDSNGVITVKPDFTGLKGPYRIETEGEKQELWKYTIDNVSPHAQPEEEERERRVFKDLYGRHKEYLSSLVGTDFEMTVPGALRLFVNGEVVSAQGYEYDNLYVHFFVELPTAHWSSPAFQQLSGVTQTCTTKSLAMDKVAHFSYPFTFEAFFLHEDESSDALPEWPVLYCEVLSLDFWQRYRVEGYGAVVLPATPGSHTLTVSTWRPVELGTVAELRRFFIGGSLELEDLSYVRIPGSFKGERLSRFGLRTETTGTVTFRLHCLQQSRAFMESSSLQKRMRSVLDRLEGFSQQSSIHNVLEAFRRARRRMQEARESLPQDLVSPSGTLVS

SEQ ID NO: 52797 - protein, 1581 aa, Homo sapiens
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGYGMTTGNNPMSGTTTPTNTFPGGPITTLFNMSMSIKDRHESVGHGEDFSKVSQNPILTSLLQITGNGGSTIGSSPTPPHHTPPPVSSMAGNTKNHPMLMNLLKDNPAQDFSTLYGSSPLERQNSSSGSPRMEICSGSNKTKKKKSSRLPPEKPKHQTEDDFQRELFSMDVDSQNPIFDVNMTADTLDTPHITPAPSQCSTPPTTYPQPVPHPQPSIQRMVRLSSSDSIGPDVTDILSDIAEEASKLPSTSDDCPAIGTPLRDSSSSGHSQSTLFDSDVFQTNNNENPYTDPADLIADAAGSPSSDSPTNHFFHDGVDFNPDLLNSQSQSGFGEEYFDESSQSGDNDDFKGFASQALNTLGVPMLGGDNGETKFKGNNQADTVDFSIISVAGKALAPADLMEHHSGSQGPLLTTGDLGKEKTQKRVKEGNGTSNSTLSGPGLDSKPGKRSRTPSNDGKSKDKPPKRKKADTEGKSPSHSSSNRPFTPPTSTGGSKSPGSAGRSQTPPGVATPPIPKITIQIPKGTVMVGKPSSHSQYTSSGSVSSSGSKSHHSHSSSSSSSASTSGKMKSSKSEGSSSSKLSSSMYSSQGSSGSSQSKNSSQSGGKPGSSPITKHGLSSGSSSTKMKPQGKPSSLMNPSLSKPNISPSHSRPPGGSDKLASPMKPVPGTPPSSKAKSPISSGSGGSHMSGTSSSSGMKSSSGLGSSGSLSQKTPPSSNSCTASSSSFSSSGSSMSSSQNQHGSSKGKSPSRNKKPSLTAVIDKLKHGVVTSGPGGEDPLDGQMGVSTNSSSHPMSSKHNMSGGEFQGKREKSDKDKSKVSTSGSSVDSSKKTSESKNVGSTGVAKIIISKHDGGSPSIKAKVTLQKPGESSGEGLRPQMASSKNYGSPLISGSTPKHERGSPSHSKSPAYTPQNLDSESESGSSIAEKSYQNSPSSDDGIRPLPEYSTEKHKKHKKEKKKVKDKDRDRDRDKDRDKKKSHSIKPESWSKSPISSDQSLSMTSNTILSADRPSRLSPDFMIGEEDDDLMDVALIGN

SEQ ID NO: 52798 - protein, 556 aa, Homo sapiens
MKAQGETEESEKLSKMSSLLERLHAKFNQNRPWSETIKLVRQVMEKRVVMSSGGHQHLVSCLETLQKALKVTSLPAMTDRLESIARQNGLGSHLSASGTECYITSDMFYVEVQLDPAGQLCDVKVAHHGENPVSCPELVQQLREKNFDEFSKHLKGLVNLYNLPGDNKLKTKMYLALQSLEQDLSKMAIMYWKATNAGPLDKILHGSVGYLTPRSGGHLMNLKYYVSPSDLLDDKTASPIILHENNVSRSLGMNASVTIEGTSAVYKLPIAPLIMGSHPVDNKWTPSFSSITSANSVDLPACFFLKFPQPIPVSRAFVQKLQNCTGIPLFETQPTYAPLYELITQFELSKDPDPIPLNHNMRFYAALPGQQHCYFLNKDAPLPDGRSLQGTLVSKITFQHPGRVPLILNLIRHQVAYNTLIGSCVKRTILKEDSPGLLQFEVCPLSESRFSVSFQHPVNDSLVCVVMDVQDSTHVSCKLYKGLSDALICTDDFIAKVVQRCMSIPVTMRAIRRKAETIQADTPALSLIAETVEDMVKKNLPPASSPGSKNPELGSG

SEQ ID NO: 52799 - protein, 135 aa, Homo sapiens
MAEKFDHLEEHLEKFVENIRQLGIIVSDFQPSSQAGLNQKLNFIVTGLQDIDKCRQQLHDITVPLEVFEYIDQGRNPQLYTKECLERALAKNEQVKGKIDTMKKFKSLLIQELSKVFPEDMAKYRSIRGEDHPPS

SEQ ID NO: 52800 - protein, 117 aa, Homo sapiens
MATYSLANERLRALEDIEREIGAILQNAGTVILELSKEKTNERLLDRQAAAFTASVQHVEAELSAQIRYLTQVATGQPHEGSSYSSRKDCQMALKRVDYARLKLSDVARTCEQMLEN

SEQ ID NO: 52801 - protein, 2180 aa, Homo sapiens
MAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQAKIQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 52802 - protein, 2177 aa, Homo sapiens
MAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 52803 - protein, 2176 aa, Homo sapiens
MAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 52804 - protein, 130 aa, Homo sapiens
  MOD_RES (1)..(1): Any amino acid
XTPNRRRKKQLNAAFLPQDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGY

SEQ ID NO: 52805 - protein, 2127 aa, Homo sapiens
EDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQLSPSSLQGYTPYVSHVGLQQHTGPADPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 52806 - protein, 925 aa, Homo sapiens
GGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQAKIQSQGMLGQSSVHQMTPSSSYGLQTSQGYTPYVSHVGLQQHTGPAGTMVPPSYSSQPYQSTHPSTNPTLVDPTRHLQQRPSGYVHQQAPTYGHGLTSTQRFSHQTLQQTPMISTMTPMSAQGVQAGVRSTAILPEQQQQQQQQQQQQQQQQQQQQQQQQQQYHIRQQQQQQILRQQQQQQQQQQQQQQQQQQQQQQQQQQHQQQQQQQAAPPQPQPQSQPQFQRQGLQQTQQQQQTAALVRQLQQQLSNTQPQPSTNIFGRY

SEQ ID NO: 52807 - protein, 251 aa, Homo sapiens
  MOD_RES (1)..(1): Any amino acid
XERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPADPTRHLQQRPSGYVHQQAPTYGHGLTSTQRFSHQTLQQTPMISTMTPMSAQGVQAGVRSTAILPEQQQQQ

SEQ ID NO: 52808 - protein, 2000 aa, Homo sapiens
MAAFGILSYEHRPLKRPRLGPPDVYPQDPKQKEDELTALNVKQGFNNQPAVSGDEHGSAKNVSFNPAKISSNFSSIIAEKLRCNTLPDTGRRKPQVNQKDNFWLVTARSQSAINTWFTDLAGTKPLTQLAKKVPIFSKKEEVFGYLAKYTVPVMRAAWLIKMTCAYYAAISETKVKKRHVDPFMEWTQIITKYLWEQLQKMAEYYRPGPAGSGGCGSTIGPLPHDVEVAIRQWDYTEKLAMFMFQDGMLDRHEFLTWVLECFEKIRPGEDELLKLLLPLLLRYSGEFVQSAYLSRRLAYFCTRRLALQLDGVSSHSSHVISAQSTSTLPTTPAPQPPTSSTPSTPFSDLLMCPQHRPLVFGLSCILQTILLCCPSALVWHYSLTDSRIKTGSPLDHLPIAPSNLPMPEGNSAFTQQVRAKLREIEQQIKERGQAVEVRWSFDKCQEATAGFTIGRVLHTLEVLDSHSFERSDFSNSLDSLCNRIFGLGPSKDGHEISSDDDAVVSLLCEWAVSCKRSGRHRAMVVAKLLEKRQAEIEAERCGESEAADEKGSIASGSLSAPSAPIFQDVLLQFLDTQAPMLTDPRSESERVEFFNLVLLFCELIRHDVFSHNMYTCTLISRGDLAFGAPGPRPPSPFDDPADDPEHKEAEGSSSSKLEDPGLSESMDIDPSSSVLFEDMEKPDFSLFSPTMPCEGKGSPSPEKPDVEKEVKPPPKEKIEGTLGVLYDQPRHVQYATHFPIPQEESCSHECNQRLVVLFGVGKQRDDARHAIKKITKDILKVLNRKGTAETDQLAPIVPLNPGDLTFLGGEDGQKRRRNRPEAFPTAEDIFAKFQHLSHYDQHQVTAQVSRNVLEQITSFALGMSYHLPLVQHVQFIFDLMEYSLSISGLIDFAIQLLNELSVVEAELLLKSSDLVGSYTTSLCLCIVAVLRHYHACLILNQDQMAQVFEGLCGVVKHGMNRSDGSSAERCILAYLYDLYTSCSHLKNKFGELFSDFCSKVKNTIYCNVEPSESNMRWAPEFMIDTLENPAAHTFTYTGLGKSLSENPANRYSFVCNALMHVCVGHHDPDRVNDIAILCAELTGYCKSLSAEWLGVLKALCCSSNNGTCGFNDLLCNVDVSDLSFHDSLATFVAILIARQCLLLEDLIRCAAIPSLLNAACSEQDSEPGARLTCRILLHLFKTPQLNPCQSDGNKPTVGIRSSCDRHLLAASQNRIVDGAVFAVLKAVFVLGDAELKGSGFTVTGGTEELPEEEGGGGSGGRRQGGRNISVETASLDVYAKYVLRSICQQEWVGERCLKSLCEDSNDLQDPVLSSAQAQRLMQLICYPHRLLDNEDGENPQRQRIKRILQNLDQWTMRQSSLELQLMIKQTPNNEMNSLLENIAKATIEVFQQSAETGSSSGSTASNMPSSSKTKPVLSSLERSGVWLVAPLIAKLPTSVQGHVLKAAGEELEKGQHLGSSSRKERDRQKQKSMSLLSQQPFLSLVLTCLKGQDEQREGLLTSLYSQVHQIVNNWRDDQYLDDCKPKQLMHEALKLRLNLVGGMFDTVQRSTQQTTEWAMLLLEIIISGTVDMQSNNELFTTVLDMLSVLINGTLAADMSSISQGSMEENKRAYMNLAKKLQKELGERQSDSLEKVRQLLPLPKQTRDVITCEPQGSLIDTKGNKIAGFDSIFKKEGLQVSTKQKISPWDLFEGLKPSAPLSWGWFGTVRVDRRVARGEEQQRLLLYHTHLRPRPRAYYLEPLPLPPEDEEPPAPTLLEPEKKAPEPPKTDKPGAAPPSTEERKKKSTKGKKRSQPATKTEDYGMGPGRSGPYGVTVPPDLLHHPNPGSITHLNYRQGSIGLYTQNQPLPAGGPRVDPYRPVRLPMQKLPTRPTYPGVLPTTMTGVMGLEPSSYKTSVYRQQQPAVPQGQRLRQQLQQSQGMLGQSSVHQMTPSSSYGLQTSQGYTPYVSHVGLQQHTGPADPTRHLQQRPSGYVHQQAPTYGHGLTSTQSFHTRHCSRHP

SEQ ID NO: 52809 - protein, 756 aa, Homo sapiens
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEEQSIMAHMGIDSGTTNIFDEVDKSDFKTDFGSEFPIFSPMPGESCENANTSLGRRMSVNCEKLVKREKPRELIFPSNYDLLRHLQYATHFPIPLVSHCFS

SEQ ID NO: 52810 - protein, 721 aa, Homo sapiens
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLVSHCFS

SEQ ID NO: 52811 - protein, 2145 aa, Homo sapiens
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWILDVLEKIRPMDDDLLKLLLPLMLQYSDEFVQSAYLSRRLAYFCARRLSLLLSDSPNLLAAHSPHMMIGPNNSSIGAPSPGPPGPGMSPVQLAFSDFLSCAQHGPLVYGLSCMLQTVTLCCPSALVWNYSTNENKSANPGSPLDLLQVAPSSLPMPGGNTAFNQQVRARIYEVEQQIKQRGRAVEVRWSFDKCQESTAGVTISRVLHTLEVLDRHCFDRTDSSNSMETLYHKIFWANQNKDNQEVAPNDEAVVTLLCEWAVSCKRSGKHRAMAVAKLLEKRQAEIEAERCGESEVLDEKESISSSSLAGSSLPVFQNVLLRFLDTQAPSLSDPNSECEKVEFVNLVLLFCEFIRHDVFSHDAYMCTLISRGDLSVTASTRPRSPVGENADEHYSKDHDVKMEIFSPMPGESCENANTSLGRRMSVNCEKLVKREKPRELIFPSNYDLLRHLQYATHFPIPLDESSSHECNQRTILLYGVGKERDEARHQLKKITKDILKILNKKSTTETGVGDEGQKARKNKQETFPTLETVFTKLQLLSYFDQHQVTSQISNNVLEQITSFASGTSYHLPLAHHIQLIFDLMEPALNINGLIDFAIQLLNELSVVEAELLLKSSSLAGSYTTGLCVCIVAVLRRYHSCLILNPDQTAQVFEGLCGVVKHVVNPSECSSPERCILAYLYDLYVSCSHLRSKFGDLFSSACSKVKQTIYNNVMPANSNLRWDPDFMMDFIENPSARSINYSMLGKILSDNAANRYSFVCNTLMNVCMGHQDAGRINDIANFSSELTACCTVLSSEWLGVLKALCCSSNHVWGFNDVLCTVDVSDLSFHDSLATFIAILIARQCFSLEDVVQHVALPSLLAAACGDADAEPGARMTCRLLLHLFRAPQACFLPQATGKPFPGIRSSCDRHLLAAAHNSIEVGAVFAVLKAIMMLGDAKIGNNSVSSLKNDDFTMRGLRCDGNADDIWTASQNPKSCGKSISIETANLREYARYVLRTICQQEWVGEHCLKEPERLCTDKELILDPVLSNMQAQKLLQLICYPHGIKECTEGDNLQRQHIKRILQNLEQWTLRQSWLELQLMIKQCLKDPGSGSVAEMNNLLDNIAKATIEVFQQSADLNNSSNSGMSLFNPNSIGSADTSSTRQNGIKTFLSSSERRGVWLVAPLIARLPTSVQGRVLKAAGEELEKGQHLGSSSKKERDRQKQKSMSLLSQQPFLSLVLTCLKGQDEQREGLLTSLQNQVNQILSNWREERYQDDIKARQMMHEALQLRLNLVGGMFDTVQRSTQWTTDWALLLLQIITSGTVDMHTNNELFTTVLDMLGVLINGTLASDLSNASPGGSEENKRAYMNLVKKLKKELGDKRSESIDKVRQLLPLPKQTCDVITCEPMGSLIDTKGNKIAGFDSIDKKQGLQVSTKQKVSPWDLFEGQKNPAPLSWAWFGTVRVDRRVIKYEEQHHLLLYHTHPMPKPRSYYLQPLPLPPEEEEEEPTSPVSQEPERKSAELSDQGKTTTDEEKKTKGRKRKTKSSSRVDEYPQSNIYRVPPNYSPISSQMMHHPQSTLWGYNLVGQPQQPGFFLQNQSLTPGGSRLDPAGSFVPTNTKQALSNMLQRRSGAMMQPPSLHAITSQQQLIQMKLLQQQQQQRLLRQAQTRPFQQGQPGDQAALFAAQARPSPQLPQYPGLQQAQTMPQGYTMYGTQMPLQQTSQQQAGSVVLSPSYNSRAYPAAHSNPVLMERLRQIQQQPSGYVQQQASPYLQPLTGSQRLNHQALQQSPLVGGGIDAVLTSAHPNLPSVPLPQDPMRPRQPQVRQQQRLLQMQQPQQPQPQQPPQPQQSSQSQSQTLGLQAMQPQQPLFPRQGLQQTQQQQQTAALVRQLQKQLSSNQPQQGVTPYGHPSHF

SEQ ID NO: 52812 - protein, 2173 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPVLLTLFTMTYQKKKMECGRMDFPMNAVLCFQAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKKSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPPIKLPEECIYRQSWTVGKLELLSSGPSMPFIKEGDGSNMDQEYGTAYTPQTHTSFGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNFDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 52813 - protein, 2174 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQEDMDWEDDSLAAVEVLVAGVRMIYPACFVLVPQSDIPTPSPVGSTHCSSSCLGVHQVPASTRDPAMSSVTLTPPTSPEEVQTVDPQSVQKWVKFSSVSDGFNSDSTSHHGGKIPRKLANHVVDRVWQECNMNRAQNKRKYSASSGGLCEEATAAKVASWDFVEATQRTNCSCLRHKNLKSRNAGQQGQAPSLGQQQQILPKHKTNEKQEKSEKPQKRPLTPFHHRVSVSDDVGMDADSASQRLVISAPDSQVRFSNIRTNDVAKTPQMHGTEMANSPQPPPLSPHPCDVVDEGVTKTPSTPQSQHFYQMPTPDPLVPSKPMEDRIDSLSQSFPPQYQEAVEPTVYVGTAVNLEEDEANIAWKYYKFPKKKDVEFLPPQLPSDKFKDDPVGPFGQESVTSVTELMVQCKKPLKVSDELVQQYQIKNQCLSAIASDAEQEPKIDPYAFVEGDEEFLFPDKKDRQNSEREAGKKHKVEDGTSSVTVLSHEEDAMSLFSPSIKQDAPRPTSHARPPSTSLIYDSDLAVSYTDLDNLFNSDEDELTPGSKKSANGSDDKASCKESKTGNLDPLSCISTADLHKMYPTPPSLEQHIMGFSPMNMNNKEYGSMDTTPGGTVLEGNSSSIGAQFKIEVDEGFCSPKPSEIKDFSYVYKPENCQILVGCSMFAPLKTLPSQYLPPIKLPEECIYRQSWTVGKLELLSSGPSMPFIKEGDGSNMDQEYGTAYTPQTHTSFGMPPSSAPPSNSGAGILPSPSTPRFPTPRTPRTPRTPRGAGGPASAQGSVKYENSDLYSPASTPSTCRPLNSVEPATVPSIPEAHSLYVNLILSESVMNLFKDCNFDSCCICVCNMNIKGADVGVYIPDPTQEAQYRCTCGFSAVMNRKFGNNSGLFLEDELDIIGRNTDCGKEAEKRFEALRATSAEHVNGGLKESEKLSDDLILLLQDQCTNLFSPFGAADQDPFPKSGVISNWVRVEERDCCNDCYLALEHGRQFMDNMSGGKVDEALVKSSCLHPWSKRNDVSMQCSQDILRMLLSLQPVLQDAIQKKRTVRPWGVQGPLTWQQFHKMAGRGSYGTDESPEPLPIPTFLLGYDYDYLVLSPFALPYWERLMLEPYGSQRDIAYVVLCPENEALLNGAKSFFRDLTAIYESCRLGQHRPVSRLLTDGIMRVGSTASKKLSEKLVAEWFSQAADGNNEAFSKLKLYAQVCRYDLGPYLASLPLDSSLLSQPNLVAPTSQSLITPPQMTNTGNANTPSATLASAASSTMTVTSGVAISTSVATANSTLTTASTSSSSSSNLNSGVSSNKLPSFPPFGSMNSNAAGSMSTQANTVQSGQLGGQQTSALQTAGISGESSSLPTQPHPDVSESTMDRDKVGIPTDGDSHAVTYPPAIVVYIIDPFTYENTDESTNSSSVWTLGLLRCFLEMVQTLPPHIKSTVSVQIIPCQYLLQPVKHEDREIYPQHLKSLAFSAFTQCRRPLPTSTNVKTLTGFGPGLAMETALRSPDRPECIRLYAPPFILAPVKDKQTELGETFGEAGQKYNVLFVGYCLSHDQRWILASCTDLYGELLETCIINIDVPNRARRKKSSARKFGLQKLWEWCLGLVQMSSLPWRVVIGRLGRIGHGELKDWSCLLSRRNLQSLSKRLKDMCRMCGISAADSPSILSACLVAMEPQGSFVIMPDSVSTGSVFGRSTTLNMQTSQLNTPQDTSCTHILVFPTSASVQVASATYTTENLDLAFNPNNDGADGMGIFDLLDTGDDLDPDIINILPASPTGSPVHSPGSHYPHGGDAGKGQSTDRLLSTEPHEEVPNILQQPLALGYFVSTAKAGPLPDWFWSACPQAQYQCPLFLKASLHLHVPSVQSDELLHSKHSHPLDSNQTSDVLRFVLEQYNALSWLTCDPATQDRRSCLPIHFVVLNQLYNFIMNML

SEQ ID NO: 52814 - protein, 2210 aa, Homo sapiens
MTAAANWVANGASLEDCHSNLFSLAELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKEEDELGYDDDFPVAVEVIVGGVRMVYPSAFVLISQNDIPVPQSVASAGGHIAVGQQGLGSVKDPSNCGMPLTPPTSPEQAILGESGGMQSAASHLVSQDGGMITMHSPKRSGKIPPKLHNHMVHRVWKECILNRTQSKRSQMSTPTLEEEPASNPATWDFVDPTQRVSCSCSRHKLLKRCAVGPNRPPTVSQPGFSAGPSSSSSLPPPASSKHKTAERQEKGDKLQKRPLIPFHHRPSVAEELCMEQDTPGQKLGLAGIDSSLEVSSSRKYDKQMAVPSRNTSKQMNLNPMDSPHSPISPLPPTLSPQPRGQETESLDPPSVPVNPALYGNGLELQQLSTLDDRTVLVGQRLPLMAEVSETALYCGIRPSNPESSEKWWHSYRLPPSDDAEFRPPELQGERCDAKMEVNSESTALQRLLAQPNKRFKIWQDKQPQLQPLHFLDPLPLSQQPGDSLGEVNDPYTFEDGDIKYIFTANKKCKQGTEKDSLKKNKSEDGFGTKDVTTPGHSTPVPDGKNAMSIFSSATKTDVRQDNAAGRAGSSSLTQVTDLAPSLHDLDNIFDNSDDDELGAVSPALRSSKMPAVGTEDRPLGKDGRAAVPYPPTVADLQRMFPTPPSLEQHPAFSPVMNYKDGISSETVTALGMMESPMVSMVSTQLTEFKMEVEDGLGSPKPEEIKDFSYVHKVPSFQPFVGSSMFAPLKMLPSHCLLPLKIPDACLFRPSWAIPPKIEQLPMPPAATFIRDGYNNVPSVGSLADPDYLNTPQMNTPVTLNSAAPASNSGAGVLPSPATPRFSVPTPRTPRTPRTPRGGGTASGQGSVKYDSTDQGSPASTPSTTRPLNSVEPATMQPIPEAHSLYVTLILSDSVMNIFKDRNFDSCCICACNMNIKGADVGLYIPDSSNEDQYRCTCGFSAIMNRKLGYNSGLFLEDELDIFGKNSDIGQAAERRLMMCQSTFLPQVEGTKKPQEPPISLLLLLQNQHTQPFASLNFLDYISSNNRQTLPCVSWSYDRVQADNNDYWTECFNALEQGRQYVDNPTGGKVDEALVRSATVHSWPHSNVLDISMLSSQDVVRMLLSLQPFLQDAIQKKRTGRTWENIQHVQGPLTWQQFHKMAGRGTYGSEESPEPLPIPTLLVGYDKDFLTISPFSLPFWERLLLDPYGGHRDVAYIVVCPENEALLEGAKTFFRDLSAVYEMCRLGQHKPICKVLRDGIMRVGKTVAQKLTDELVSEWFNQPWSGEENDNHSRLKLYAQVCRHHLAPYLATLQLDSSLLIPPKYQTPPAAAQGQATPGNAGPLAPNGSAAPPAGSAFNPTSNSSSTNPAASSSASGSSVPPVSSSASAPGISQISTTSSSGFSGSVGGQNPSTGGISADRTQGNIGCGGDTDPGQSSSQPSQDGQESVTERERIGIPTEPDSADSHAHPPAVVIYMVDPFTYAAEEDSTSGNFWLLSLMRCYTEMLDNLPEHMRNSFILQIVPCQYMLQTMKDEQVFYIQYLKSMAFSVYCQCRRPLPTQIHIKSLTGFGPAASIEMTLKNPERPSPIQLYSPPFILAPIKDKQTELGETFGEASQKYNVLFVGYCLSHDQRWLLASCTDLHGELLETCVVNIALPNRSRRSKVSARKIGLQKLWEWCIGIVQMTSLPWRVVIGRLGRLGHGELKDWSILLGECSLQTISKKLKDVCRMCGISAADSPSILSACLVAMEPQGSFVVMPDAVTMGSVFGRSTALNMQSSQLNTPQDASCTHILVFPTSSTIQVAPANYPNEDGFSPNNDDMFVDLPFPDDMDNDIGILMTGNLHSSPNSSPVPSPGSPSGIGVGSHFQHSRSQGERLLSREAPEELKQQPLALGYFVSTAKAENLPQWFWSSCPQAQNQCPLFLKASLHHHISVAQTDELLPARNSQRVPHPLDSKTTSDVLRFVLEQYNALSWLTCNPATQDRTSCLPVHFVVLTQLYNAIMNIL

SEQ ID NO: 52815 - protein, 1454 aa, Homo sapiens
MAPVQLENHQLVPPGGGGGGSGGPPSAPAPPPPGAAVAAAAAAAASPGYRLSTLIEFLLHRAYSELMVLTDLLPRKSDVERKIEIVQFASRTRQLFVRLLALVKWANNAGKVEKCAMISSFLDQQAILFVDTADRLASLARDALVHARLPSFAIPYAIDVLTTGSYPRLPTCIRDKIIPPDPITKIEKQATLHQLNQILRHRLVTTDLPPQLANLTVANGRVKFRVEGEFEATLTVMGDDPDVPWRLLKLEILVEDKETGDGRALVHSMQISFIHQLVQSRLFADEKPLQDMYNCLHSFCLSLQLEVLHSQTLMLIRERWGDLVQVERYHAGKCLSLSVWNQQVLGRKTGTASVHKVTIKIDENDVSKPLQIFHDPPLPASDSKLVERAMKIDHLSIEKLLIDSVHARAHQKLQELKAILRGFNANENSSIETALPALVVPILEPCGNSECLHIFVDLHSGMFQLMLYGLDQATLDDMEKSVNDDMKRIIPWIQQLKFWLGQQRCKQSIKHLPTISSETLQLSNYSTHPIGNLSKNKLFIKLTRLPQYYIVVEMLEVPNKPTQLSYKYYFMSVNAADREDSPAMALLLQQFKENIQDLVFRTKTGKQTRTNAKRKLSDDPCPVESKKTKRAGEMCAFNKVLAHFVAMCDTNMPFVGLRLELSNLEIPHQGVQVEGDGFSHAIRLLKIPPCKGITEETQKALDRSLLDCTFRLQGRNNRTWVAELVFANCPLNGTSTREQGPSRHVYLTYENLLSEPVGGRKVVEMFLNDWNSIARLYECVLEFARSLPDIPAHLNIFSEVRVYNYRKLILCYGTTKGSSISIQWNSIHQKFHISLGTVGPNSGCSNCHNTILHQLQEMFNKTPNVVQLLQVLFDTQAPLNAINKLPTVPMLGLTQRTNTAYQCFSILPQSSTHIRLAFRNMYCIDIYCRSRGVVAIRDGAYSLFDNSKLVEGFYPAPGLKTFLNMFVDSNQDARRRSVNEDDNPPSPIGGDMMDSLISQLQPPPQQQPFPKQPGTSGAYPLTSPPTSYHSTVNQSPSMMHTQSPGNLHAASSPSGALRAPSPASFVPTPPPSSHGISIGPGASFASPHGTLDPSSPYTMVSPSGRAGNWPGSPQVSGPSPAARMPGMSPANPSLHSPVPDASHSPRAGTSSQTMPTNMPPPRKLPQRSWAASIPTILTHSALNILLLPSPTPGLVPGLAGSYLCSPLERFLGSVIMRRHLQRIIQQETLQLINSNEPGVIMFKTDALKCRVALSPKTNQTLQLKVTPENAGQWKPDELQVLEKFFETRVAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTTQQADIPRQQNSSVAAPMMVSNILKRFAEMNPPRQGECTIFAAVRDLMANLTLPPGGRP

SEQ ID NO: 52816 - protein, 155 aa, Homo sapiens
VAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTTQQADIPRQQNSSVAAPMMVSNILKRFAEMNPPRQGSIKGTGCPSDFL

SEQ ID NO: 52817 - protein, 331 aa, Homo sapiens
PSGRAGNWPGSPQVSGPSPAARMPGMSPANPSLHSPVPDASHSPRAGTSSQTMPTNMPPPRKLPQRSWAASIPTILTHSALNILLLPSPTPGLVPGLAGSYLCSPLERFLGSVIMRRHLQRIIQQETLQLINSNEPGVIMFKTDALKCRVALSPKTNQTLQLKVTPENAGQWKPDELQVLEKFFETRVAGPPFKANTLIAFTKLLGAPTHILRDCVHIMKLELFPDQATQLKWNVQFCLTIPPSAPPIAPPGTPAVVLKSKMLFFLQLTQKTSVPPQEPVSIIVPIIYDMASGTTQQADIPRQQNSSVAAPMMVSNILKRFAEMNPPRQGT

SEQ ID NO: 52818 - protein, 788 aa, Homo sapiens
MDVSGQETDWRSTAFRQKLVSQIEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQMITEALAQGGMHIRARFPPTTAVSAIPSSSIPLGRQPMAQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 52819 - protein, 748 aa, Homo sapiens
MDVSGQETDWRSTAFRQKLVSQIEDAMRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 52820 - protein, 677 aa, Homo sapiens
MDVSGQETDWRSTAFRQKLVSQIEDAMRKAGVAHSKSSKDMESHVFLKAKTRDEYLSLVARLIIHFRDIHNKKSQASVSAQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 52821 - protein, 722 aa, Homo sapiens
MRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 52822 - protein, 637 aa, Homo sapiens
MESHVFLKAKTRDEYLSLVARLIIHFRDIHNKKSQASVSAQLQLQQVALQQQQQQQQFQQQQQAALQQQQQQQQQQQFQAQQSAMQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQVSQSSLPMLSSPSPGQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 52823 - protein, 722 aa, Homo sapiens; identical to SEQ ID NO: 52821

SEQ ID NO: 52824 - protein, 718 aa, Homo sapiens
MRKAGVAHSKSSKDMESHVFLKAKTRDEYLSLVARLIIHFRDIHNKKSQASVSDPMNALQSLTGGPAAGAAGIGMPPRGPGQSLGGMGSLGAMGQPMSLSGQPPPGTSGMAPHSMAVVSTATPQTQLQLQQVALQQQQQQQQFQQQQQAALQQQQQQQQQQQFQAQQSAMQQQFQAVVQQQQQLQQQQQQQQHLIKLHHQNQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQMITEALAQGGMHIRARFPPTTAVSAIPSSSIPLGRQPMAQQVQTPQSMPPPPQPSPQPGQPSSQPNSNVSSGPAPSPSSFLPSPSPQPSQSPVTARTPQNFSVPSPGPLNTPVNPSSVMSPAGSSQAEEQQYLDKLKQLSKYIEPLRRMINKIDKNEDRKKDLSKMKSLLDILTDPSKRCPLKTLQKCEIALEKLKNDMAVPTPPPPPVPPTKQQYLCQPLLDAVLANIRSPVFNHSLYRTFVPAMTAIHGPPITAPVVCTRKRRLEDDERQSIPSVLQGEVARLDPKFLVNLDPSHCSNNGTVHLICKLDDKDLPSVPPLELSVPADYPAQSPLWIDRQWQYDANPFLQSVHRCMTSRLLQLPDKHSVTALLNTWAQSVHQACLSAA

SEQ ID NO: 52825 - protein, 189 aa, Homo sapiens
MQQQFQAVVQQQQQLQQQQQQQQHLIKLHHQNQQQIQQQQQQLQRIAQLQLQQQQQQQQQQQQQQQQALQAQPPIQQPPMQQPQPPPSQALPQQLQQMHHTQHHQPPPQPQQPPVAQNQPSQLPPQSQTQPLVSQAQALPGQMLYTQPPLKFVRAPMVVQQPPVQPQVQQQQTAVQTAQAAQMVAPGVQ

SEQ ID NO: 52826 - protein, 651 aa, Homo sapiens
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVSIQKQAPDIGDLGTVNLFKRPLPKSKPGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 52827 - protein, 621 aa, Homo sapiens
MSGVRAVRISIESACEKQVHEVGLDGTETYLPPLSMSQEWPGAGSSADQDDEEGVVKFQPSLWPWDSVRNNLRSALTEMCVLYDVLSIVRDKKFMTLDPVSQDALPPKQNPQTLQLISKKKSLAGAAQILLKGAERLTKSVTENQENKLQRDFNSELLRLRQHWKLRKVGDKILGDLSYRSAGSLFPHHGTFEVIKNTDLDLDKKIPEDYCPLDVQIPSDLEGSAYIKVSIQKQAPDIGDLGTVNLFKRPLPKSKPGSPHWQTKLEAAQNVLLCKEIFAQLSREAVQIKSQVPHIVVKNQIISQPFPSLQLSISLCHSSNDKKSQKFATEKQCPEDHLYVLEHNLHLLIREFHKQTLSSIMMPHPASAPFGHKRMRLSGPQAFDKNEINSLQSSEGLLEKIIKQAKHIFLRSRAAATIDSLASRIEDPQIQAHWSNINDVYESSVKVLITSQGYEQICKSIQLQLNIGVEQIRVVHRDGRVITLSYQEQELQDFLLSQMSQHQVHAVQQLAKVMGWQVLSFSNHVGLGPIESIGNASAITVASPSGDYAISVRNGPESGSKIMVQFPRNQCKDLPKSDVLQDNKWSHLRGPFKEVQWNKMEGRNFVYKMELLMSALSPCLL

SEQ ID NO: 52828 - protein, 145 aa, Homo sapiens
MSGVRAVRISIESACEKQVHEVGLDGTETYLPPLSMSQNLARLAQRIDFSQGSGSEEEEAAGTEGDAQEWPGAGSSADQDDEEGVVKFQPSLWPWDSVRNNLRSALTEMCVLYDVLSIVRDKKFMTLDPVSQDALPPKQVFVDFN

SEQ ID NO: 52829 - protein, 208 aa, Homo sapiens [sequence omitted]

SEQ ID NO: 52830 - protein, 208 aa, Homo sapiens [sequence omitted]

SEQ ID NO: 52831 - protein, 194 aa, Homo sapiens
MENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKVKEKLSNFLPDLPGMIDLPGSHDNSSLRSLIEKPPILSSSFNPITGTMLAGFRLHTGPLPEQCRLMHIQPPKKKNKHKHKQSRTQDPVPPGKPS

SEQ ID NO: 52832 - protein, 244 aa, Homo sapiens
MENFTALFGAQADPPPPPTALGFGPGKPPPPPPPPAGGGPGTAPPPTAATAPPGADKSGAGCGPFYLMRELPGSTELTGSTNLITHYNLEQAYNKFCGKKVKEKLSNFLPDLPGMIDLPGSHDNSSLRSLIEKPPILSSSFNPITGTMLAGFRLHTGPLPEQCRLMHIQPPKKKNKHKHKQSRTQDPVPPETPSDSDHKKKKKKKEEDPERKRKKKEKKKKKNRHSPDHPGMGSSQASSSSSLR

SEQ ID NO: 52833 - protein, 212 aa, Homo sapiens
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCVVASDCWSLLLEFLQSFLGSHTPGAPAVFGNRHDAVYGPADTMVQYMELFNKIRKQQQVPVAGIR

SEQ ID NO: 52834 - protein, 140 aa, Homo sapiens
MPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVEYGPCV

SEQ ID NO: 52835 - protein, 145 aa, Homo sapiens
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRYQYCDFLVKVGTVTMGPSARGISVEVRPW

SEQ ID NO: 52836 - protein, 123 aa, Homo sapiens
MGVTCVSQMPVAEGKSVQQTVELLTRKLEMLGAEKQGTFCVDCETYHTAASTLGSQGQTGKLMYVMHNSEYPLSCFALFENGPCLIADTNFDVLMVKLKGFFQSAKASKIETRGTRWSMAPVW

SEQ ID NO: 52837 - protein, 144 aa, Homo sapiens
MADRLTQLQDAVNSLADQFCNAIGVLQQCGPPASFNNIQTAINKDQPANPTEEYAQLFAALIARTAKDIDVLIDSLPSEESTAALQAASLYKLEEENHEAATCLEDVVYRGDMLLEKIQSALADIAQSQLKTRSGTHSQSLPDS

SEQ ID NO: 52838 - protein, 1365 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQTLNIAQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQ

SEQ ID NO: 52839 - protein, 886 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQTLNIAQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLVRINTFLSLFS

SEQ ID NO: 52840 - protein, 1374 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQTLNIAQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVKKIICNLKPALKLRLRFITHISKMEPAAVPPQAMNSGSPAPQSNQVPVSLPVTQ

SEQ ID NO: 52841 - protein, 1364 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVDTLT

SEQ ID NO: 52842 - protein, 1368 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 52843 - protein, 1374 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQLISALQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 52844 - protein, 37 aa, Homo sapiens [sequence omitted]

SEQ ID NO: 52845 - protein, 43 aa, Homo sapiens [sequence omitted]

SEQ ID NO: 52846 - protein, 475 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHESAFANCFQITCMGDLTHTP

SEQ ID NO: 52847 - protein, 142 aa, Homo sapiens
MHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQTLLILGELALRKT

SEQ ID NO: 52848 - protein, 886 aa, Homo sapiens
METQLQSIFEEVVKTEVIEEAFPGMFMDTPEDEKTKLISCLGAFRQFWGGLSQESHEQCIQWIVKFIHGQHSPKRISFLYDCLAMAVETGLLPPRLVCESLINSDTLEWERTQLWALTFKLVRKIIGGVDYKGVRDLLKVILEKILTIPNTVSSAVVQQLLAAREVIAYILERNACLLPAYFAVTEIRKLYPEGKLPHWLLGNLVSDFVDTFRPTARINSICGRCSLLPVVNNSGAICNSWKLDPATLRFPLKGLLPYDKDLFEPQTALLRYVLEQPYSRDMVCNMLGLNKQVLKIFKHKQRCPVLEDQLVDLVVYAMERSETEEKFDDGGTSQLLWQHLSSQLIFFVLFQFASFPHMVLSLHQKLAGRGLIKGRDHLMWVLLQFISGSIQKNALADFLPVMKLFDLLYPEKEYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLVRINTFLSLFS

SEQ ID NO: 52849 - protein, 1009 aa, Homo sapiens
MERSETEEKFDDGGTSQLLWQHLSSQLIFFVLFQFASFPHMVLSLHQKYIPVPDINKPQSTHAFAMTCIWIHLNRKAQNDNSKLQIPIPHSLRLHHEFLQQSLRNKSLQMNDYKIALLCNAYSTNSECFTLPMGALVETIYGNGIMRIPLPGTNCMASGSITPLPMNLLDSLTVHAKMSLIHSIATRVIKLAHAKSSVALAPALVETYSRLLVYMEIESLGIKGFISQLLPTVFKSHAWGILHTLLEMFSYRMHHIQPHYRVQLLSHLHTLAAVAQTNQNQLHLCVESTALRLITALGSSEVQPQFTRFLSDPKTVLSAESEELNRALILTLARATHVTDFFTGSDSIQGTWCKDILQTIMSFTPHNWASHTLSCFPGPLQAFFKQNNVPQESRFNLKKNVEEEYRKWKSMSNENDIITHFSMQGSPPLFLCLLWKMLLETDHINQIGYRVLERIGARALVAHVRTFADFLVYEFSTSAGGQQLNKCIEILNDMVWKYNIVTLDRLILCLAMRSHEGNEAQVCYFIIQLLLLKPNDFRNRVSDFVKENSPEHWLQNDWHTKHMNYHKKYPEKLYFEGLAEQVDPPVQIQSPYLPIYFGNVCLRFLPVFDIVIHRFLELLPVSKSLETLLDHLGGLYKFHDRPVTYLYNTLHYYEMHLRDRAFLKRKLVHAIIGSLKDNRPQGWCLSDTYLKCAMNAREENPWVPDDTYYCRLIGRLVDTMAGKSPGPFPNCDWRFNEFPNPAAHALHVTCVELMALAVSGKEVGNALLNVVLKSQPLVPRENITAWMNAIGLIITALPEPYWIVLHDRIVSVISSPSLTSETEWVGYPFRLFDFTACHQSYSEMSCSYTLALAHAVWHHSSIGQLSLIPKFLTEVLLPIVKTEFQLLYVYHLVGPFLQRFQQERTRCMIEIGVAFYDMLLNVDQCSTHLNYMDPICDFLYHMKYMFTGDSVKEQVEKIICNLKPALKLRLRFITHISKMEPAAVPPQAMNSGSPAPQSNQVPVSLPVTQ

SEQ ID NO: 52850 - protein, 989 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 52851 - protein, 989 aa, Homo sapiens; identical to SEQ ID NO: 52850

SEQ ID NO: 52852 - protein, 976 aa, Homo sapiens
MKVVNLKQAILQAWKERWSDYQWAINMKKFFPKGATWDILNLADALLEQAMIGPSPNPLILSYLKYAISSQFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 52853 - protein, 989 aa, Homo sapiens; identical to SEQ ID NO: 52850

SEQ ID NO: 52854 - protein, 287 aa, Homo sapiens
  MOD_RES (1)..(1): Any amino acid
XNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPRSSLGSPCTSYLRWVKVGLGHPRGAPLLHSAGCFPALHLLRPTADRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 52855 - protein, 301 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASLHTSQGLGQGGTRANQPTASWTAIEHSLLKLGEILANLSNPQLRSQAEQCGTLIRSIPTMLSVHAEQMHKTGFPTVHAVILLEGTMNLTGETQSLVEQLTMVKRMQHIPTPLFV

SEQ ID NO: 52856 - protein, 899 aa, Homo sapiens
MPLVPRWCPTLLSSQPSVSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 52857 - protein, 251 aa, Homo sapiens
MKKFFPKGATWDILNLADALLEQAMIGPSPNPLILSYLKYAISSQMVSYSSVLTAIMEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVT

SEQ ID NO: 52858 - protein, 821 aa, Homo sapiens
MIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISPKVVLAITDLSLPLGRQVAAKAIAAL

SEQ ID NO: 52859 - protein, 341 aa, Homo sapiens
MKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVT

SEQ ID NO: 52860 - protein, 931 aa, Homo sapiens
MKVVNLKQAILQAWKERWSDYQWAINMKKFFPKGATWDILNLADALLEQAMIGPSPNPLILSYLKYAISSQMVSYSSVLTAIMCLQRLEKTLSSTKNRALLHIAKLEEASLHTSQGLGQGGTRANQPTASWTAIEHSLLKLGEILANLSNPQLRSQAEQCGTLIRSIPTMLSVHAEQMHKTGFPTVHAVILLEGTMNLTGETQSLVEQLTMVKRMQHIPTPLFVLEIWKACFVGLIESPEGTEELKWTAFTFLKIPQVLVKLKKYSHGDKDFTEDVNCAFEFLLKLTPLLDKADQRCNCDCTNFLLQECGKQGLLSEASVNNLMAKRKADREHAPQQKSGENANIQPNIQLILRAEPTVTNILKTMDADHSKSPEGLLGVLGHMLSGKSLDLLLAAAAATGKLKSFARKFINLNEFTTYGSEESTKPASVRALLFDISFLMLCHVAQTYGSEVILSESRTGAEVPFFETWMQTCMPEEGKILNPDHPCFRPDSTKVESLVALLNNSSEMKLVQMKWHEACLSISAAILEILNAWENGVLAFESIQKITDNIKGKVCSLAVCAVAWLVAHVRMLGLDEREKSLQMIRQLAGPLFSENTLQFYNERVVIMNSILERMCADVLQQTATQIKFPSTGVDTMPYWNLLPPKRPIKEVLTDIFAKVLEKGWVDSRSIHIFDTLLHMGGVYWFCNNLIKELLKETRKEHTLRAVELLYSIFCLDMQQVTLVLLGHILPGLLTDSSKWHSLMDPPGTALAKLAVWCALSSYSSHKGQASTRQKKRHREDIEDYISLFPLDDVQPSKLMRLLSSNEDDANILSSPTDRSMSSSLSASQLHTVNMRDPLNRVLANLFLLISSILGSRTAGPHTQFVQWFMEECVDCLEQGGRGSVLQFMPFTTVSELVKVSAMSSPKVVLAITDLSLPLGRQVAAKAIAAL

SEQ ID NO: 52861 - protein, 147 aa, Homo sapiens
MKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHFMPFTTVSELVKVSAMSSPKVVLAITDLSLPLGRQVAAKAIAAL

SEQ ID NO: 52862 - protein, 306 aa, Homo sapiens
MKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMNLTGETQSLVEQLTMVKRMQHIPTPLFGRGSVLQFMPFTTVSELVKVSAMSSPKVVLAITDLSLPLGRQVAAKAIAAL

SEQ ID NO: 52863 - protein, 747 aa, Homo sapiens
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 52864 - protein, 755 aa, Homo sapiens
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHHLPSPGPHNFPLGLHCQVRGPGGGQRSGLSVPAAPGLEHQDRVLLGSKDIGSKNEGSPIRACSPASWRTTSSWISSESPTPNKVPF

SEQ ID NO: 52865 - protein, 782 aa, Homo sapiens
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPAAKRKREGEGRVFREKWERAYFFVEVKSMPMCLICKQIVSVLKEYNLKRHYESKHSKSYDQYTEQTR

SEQ ID NO: 52866 - protein, 482 aa, Homo sapiens
MVPGSEGPARAGSVVADVVFVIEGTANLGPYFEGLRKHYLLPAIEYFNGGPPAPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 52867 - protein, 794 aa, Homo sapiens
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPDGARRSDAAERGSPGPGRSPQSPPLPLGFPVRQRVTAFHVSITSGKTKERRRGPCVSRKMGASLFLCGSEEHAYVFNMQTNRVCVERIQPETPL

SEQ ID NO: 52868 - protein, 724 aa, Homo sapiens
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGKGTRGRAEVWTECPSSSWARAPRPSAPGK

SEQ ID NO: 52869 - protein, 250 aa, Homo sapiens
MLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPIFGPRTLGPTLSCEASSSTHHRRRLGCPHPRPPSTTSSHQGLLRCCLRRQGLGQPQLGPHSCIHHLPSPGPHNFPLGLHCQVRGPGGGQRSGLSVPAAPGLEHQDRVLLGSKDIGSKNEGSPMAFAEL

SEQ ID NO: 52870 - protein, 534 aa, Homo sapiens
MVPGSEGPARAGSVVADVVFVIEGTANLGPYFEGLRKHYLLPAIEYFNGGPPAETDFGGDVPGNLSAAQVAAQNAVEAAKNQKAGLGPRFSPITPLQQAAPGVGPPFSQAPAPQLPPGPPGAPKPPPASQPSLVSTVAPGSGLAPTAQPGAPSMAGTVAPGGVSGPSPAQLGAPALGGQQSVSNKLLAWSGVLEWQEKPKPASVDANTKLTRSLPCQVYVNHGENLKTEQWPQKLIMQLIPQQLLTTLGPLFRNSRMVQFHFTNKDLESLKGLYRIMGNGFAGCVHFPHTAPCEVRVLMLLYSSKKKIFMGLIPYDQSGFVNGIRQVITNHKQVQQQKLEQQQRGMGGQQAPPGLGPILEDQARPSQNLLQLRPPQPQPQGTVGASGATGQPQPQGTAQPPPGAPQGPPGAASGPPPPGPILRPQNPGANPQLRSLLLNPPPPQTGVPPPQASLHHLQPPGAPALLPPPHQGLGQPQLGPPLLHPPPAQSWPAQLPPRAPLPGQMLLSGGPRGPVPQPGLQPSVMEDDILMDLI

SEQ ID NO: 52871 - protein, 397 aa, Homo sapiens
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPPALLEPLQPPTDVSQDPRHMVLVRGLVLPVGGGSAPGPLQSKQPVPLPPAAPSGATLSAAPQQPLPPVPPQYQVPGNLSAAQVAAQNAVEAAKNQKAGLGPRFSPITPLQQAAPGVGPPFSQAPAPALLPPPHQGLGQPQLGPPLLHPPPAQSWPAQLPPRAPLPGQMLLSGGPRGPVPQPGLQPSVMEDDILMDLI

SEQ ID NO: 52872 - protein, 259 aa, Homo sapiens
MVPGSEGPARAGSVVADVVFVIEGTANLGPYFEGLRKHYLLPAIEYFNGGPPAETDFGGDYGGTQYSLVVFNTVDCAPESYVQCHAPTSSAYEFVTWLDGIKFMGGGGESCSLIAEGLSTALQLFDDFKKMREQIGQTHRVCLLICNSPPYLLPAVESTTYSGCTTENLVQQIGERGIHFSIVSPRKLPALRLLFEKAAPGLAGAAAASDRCEPGPEAHGAGSGTRAACWGWLSPRPPPVKAASPPASRRTLRCQVRCC

SEQ ID NO: 52873 - protein, 600 aa, Homo sapiens
MTAAPASPQQIRDRLLQAIDPQSNIRNMVAVLEVISSLEKYPITKEALEETRLGKLINDVRKKTKNEELAKRAKKLLRSWQKLIEPAHQHEAALRGLAGATGSANGGAHNCRPEVGAAGPPRSIHDLKSRNDLQRLPGQRLDRLGSRKRRGDQRDLGHPGPPPKVSKASHDPLVPNSSPLPTNGISGSPESFASSLDGSGHAGPEGSRLERDENDKHSGKIPVNAVRPHTSSPGLGKPPGPCLQPKASVLQQLDRVDETPGPPHPKGPPRCSFSPRNSRHEGSFARQQSLYAPKGSVPSPSPRPQALDATQVPSPLPLAQPSTPPVRRLELLPSAESPVCWLEQPESHQRLAGPGCKAGLSPAEPLLSRAGFSPDSSKADSDAASSGGSDSKKKKRYRPRDYTVNLDGQVAEAGVKPVRLKERKLTFDPMTRQIKPLTQKEPVRADSPVHMEQQSRTELDKQEAKASLQSPFEQTNWKELSRNEIIQSYLSRQSSLLSSSGAQTPGAHHFMSEYLKQEESTRQGARQLHVLVPQSPPTDLPGLTREVTQDDLDRIQASQWPGVNGCQDTQGNWYDWTQCISLDPHGDDGRLNILPYVCLD

SEQ ID NO: 52874 - protein, 93 aa, Homo sapiens
MTAAPASPQQIRDRLLQAIDPQSNIRNMVAVLEVISSLEKYPITKEALEETRLGKLINDVRKKTKNEELAKRAKKLLPGWQWACRPRGQPPGA

SEQ ID NO: 52875 - protein, 311 aa, Homo sapiens
MADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLVTLGKVLKVIVVMRSLFIDRTIVKGYNENVYTEDGKLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 52876 - protein, 237 aa, Homo sapiens
MRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 52877 - protein, 275 aa, Homo sapiens
MADVINVSVNLEAFSQAISAIQALRSSVSRVFDCLKDGMRNKETLEGREKAFIAHFQDNLHSVNRDLNELERLSNLVGKPSENHPLHNSGLLSLDPVQDKTPLYSQLLQAYKWSNKLQYHAGLASGLLNQQSLKRSANQMGVSAKRRPKAQPTTLVLPPQYVDDVISRIDRMFPEMSIHLSRPNGTSAMLLLDIWSKSNYQVFQKVTDHATTALLHYQLPQMPDVVVRSFMTWLRSYIKLFQAPCQRCGKFLQDGLPPTWRDFRTLEAFHDTCRQ

SEQ ID NO: 52878 - protein, 221 aa, Homo sapiens
MLKSNGERRSRNALPAVYARKMAASQQQASAASSAAGVSGPSSAGGPGPQQQPQPPAQLVGPAQSGLLQQQQQDFDPVQRYKMLIPQLKESLQTLMKVAAQNLIQNTNIDNGQKSSDGPIQRFDKCLEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 52879 - protein, 139 aa, Homo sapiens
MLIPQLKESLQTLMKVAAQNLIQNTNIDNGQKSSDGPIQRFDKCLEEFYALCDQLELCLRLAHECLSQSCDSAKHSPTLVPTATKPDAVQPDSLPYPQYLAVIKAQISCAKDIHTALLDCANKVTGKTPAPPAGPGGTL

SEQ ID NO: 52880 - protein, 178 aa, Homo sapiens
MSTPPLAASGMAPGPFAGPQAQQAAREVNTASLCRIGQETVQDIVYRTMEIFQLLRNMQLPNGVTYHTGTYQDRLTKLQDNLRQLSVLFRKLRLVYDKCNENCGGMDPIPVEQLIPYVEEDGSKNDDRAGPPRFASEERREIAEVNKKLKQKNQQLKQIMDQLRNLIWDINAMLAMRN

SEQ ID NO: 52881 - protein, 270 aa, Homo sapiens
MAASSSGEKEKERLGGGLGVAGGNSTRERLLSALEDLEVLSRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 52882 - protein, 224 aa, Homo sapiens
MLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 52883 - protein, 248 aa, Homo sapiens
MKLLWWCDWLPERSHVFTQRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMSTDSSSSSSESD

SEQ ID NO: 52884 - protein, 238 aa, Homo sapiens
MKLLWWCDWLPERSHVFTQRELIEMLAISRNQKLLQAGEENQVLELLIHRDGEFQELMKLALNQGKIHHEMQVLEKEVEKRDSDIQQLQKQLKEAEQILATAVYQAKEKLKSIEKARKGAISSEEIIKYAHRISASNAVCAPLTWVPGDPRRPYPTDLEMRSGLLGQMNNPSTNGVNGHLPGDALAAGRLPDVLAPQYPWQSNDMSMNMLPPNHSSDFLLEPPGHNKENEDDVEIMST

SEQ ID NO: 52885 - protein, 233 aa, Homo sapiens
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDADDSNNCTGQNEHQRENSGHRRDQIIEKDAALCVLIDEMNERP

SEQ ID NO: 52886 - protein, 233 aa, Homo sapiens; identical to SEQ ID NO: 52885

SEQ ID NO: 52887 - protein, 195 aa, Homo sapiens
MGEPQQVSALPPPPMQYIKEYTDENIQEGLAPKPPPPIKDSYMMFGNQFQCDDLIIRPLESQGIERLHPMQFDHKKELRKLNMSILINFLDLLDILIRSPGSIKREEKLEDLKLLFVHVHHLINEYRPHQARETLRVMMEVQKRQRLETAERFQKHLERVIEMIQNCLASLPDDLPHSEAGMRVKTEPMDADDSN

SEQ ID NO: 52888 - protein, 146 aa, Homo sapiens
MASAGVAAGRQAEDVLPPTSDQPLPDTKPLPPPQPPPVPAPQPQQSPAPRPQSPARAREEENYSFLPLVHNIIKCMDKDSPEVHQDLNALKSKFQEMRKLISTMPGIHLSPEQQQQQLQSLREQVRTKNELLQKYKSLCMFEIPKE

SEQ ID NO: 52889 - protein, 297 aa, Homo sapiens
MSNRVVCREASHAGSWYTASGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 52890 - protein, 300 aa, Homo sapiens
MPLWRADKCQDVQSASWRPRRADGPQLNAQLEGWLSQVQSTKRPARAIIAPHAGYTYCGSCAAHAYKQVDPSITRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 52891 - protein, 297 aa, Homo sapiens; identical to SEQ ID NO: 52889

SEQ ID NO: 52892 - protein, 274 aa, Homo sapiens
MSNRVVCREASHAGSWYTASGPQLNAQLEGWLSQVQSTKRPARAIIAPRRIFILGPSHHVPLSRCALSSVDIYRTPLYDLRIDQKIYGELWKTGMFERMSLQTDEDEHSIEMHLPYTAKAMESHKDEFTIIPVLVGALSESKEQEFGKLFSKYLADPSNLFVVSSDFCHWGQRFRYSYYDESQGEIYRSIEHLDKMGMSIIEQLDPVSFSNYLKKYHNTICGRHPIGVLLNAITELQKNGMNMSFSFLNYAQSSQCRNWQDSSVSYAAGALTVH

SEQ ID NO: 52893 - protein, 20 aa, Homo sapiens
MSNRVVCREASHAGSWYTAS

SEQ ID NO: 52894 - protein, 1825 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 52895 - protein, 2089 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 52896 - protein, 162 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRL

SEQ ID NO: 52897 - protein, 113 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSH

SEQ ID NO: 52898 - protein, 127 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLL

SEQ ID NO: 52899 - protein, 162 aa, Homo sapiens; identical to SEQ ID NO: 52896

SEQ ID NO: 52900 - protein, 306 aa, Homo sapiens
  MOD_RES (1)..(1): Any amino acid
XHVGGTKDSEDNYGDSEDLDLQATQCFLENQGLEAVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVP

SEQ ID NO: 52901 - protein, 127 aa, Homo sapiens; identical to SEQ ID NO: 52898

SEQ ID NO: 52902 - protein, 306 aa, Homo sapiens; identical to SEQ ID NO: 52900
  MOD_RES (1)..(1): Any amino acid

SEQ ID NO: 52903 - protein, 306 aa, Homo sapiens; identical to SEQ ID NO: 52900
  MOD_RES (1)..(1): Any amino acid

SEQ ID NO: 52904 - protein, 2089 aa, Homo sapiens; identical to SEQ ID NO: 52895

SEQ ID NO: 52905 - protein, 2089 aa, Homo sapiens; identical to SEQ ID NO: 52895

SEQ ID NO: 52906 - protein, 1655 aa, Homo sapiens
MYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 52907 - protein, 162 aa, Homo sapiens; identical to SEQ ID NO: 52896

SEQ ID NO: 52908 - protein, 113 aa, Homo sapiens; identical to SEQ ID NO: 52897

SEQ ID NO: 52909 - protein, 113 aa, Homo sapiens; identical to SEQ ID NO: 52897

SEQ ID NO: 52910 - protein, 127 aa, Homo sapiens; identical to SEQ ID NO: 52898

SEQ ID NO: 52911 - protein, 162 aa, Homo sapiens; identical to SEQ ID NO: 52896

SEQ ID NO: 52912 - protein, 113 aa, Homo sapiens; identical to SEQ ID NO: 52897

SEQ ID NO: 52913 - protein, 162 aa, Homo sapiens; identical to SEQ ID NO: 52896

SEQ ID NO: 52914 - protein, 127 aa, Homo sapiens; identical to SEQ ID NO: 52898

SEQ ID NO: 52915 - protein, 306 aa, Homo sapiens; identical to SEQ ID NO: 52900
  MOD_RES (1)..(1): Any amino acid

SEQ ID NO: 52916 - protein, 2089 aa, Homo sapiens; identical to SEQ ID NO: 52895

SEQ ID NO: 52917 - protein, 1802 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPELQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 52918 - protein, 113 aa, Homo sapiens; identical to SEQ ID NO: 52897

SEQ ID NO: 52919 - protein, 2089 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKTPETVVPTAPELQISTSTDQPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPALQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 52920 - protein, 245 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEA

SEQ ID NO: 52921 - protein, 113 aa, Homo sapiens; identical to SEQ ID NO: 52897

SEQ ID NO: 52922 - protein, 127 aa, Homo sapiens; identical to SEQ ID NO: 52898

SEQ ID NO: 52923 - protein, 2089 aa, Homo sapiens; identical to SEQ ID NO: 52895

SEQ ID NO: 52924 - protein, 162 aa, Homo sapiens; identical to SEQ ID NO: 52896

SEQ ID NO: 52925 - protein, 306 aa, Homo sapiens; identical to SEQ ID NO: 52900
  MOD_RES (1)..(1): Any amino acid

SEQ ID NO: 52926 - protein, 306 aa, Homo sapiens; identical to SEQ ID NO: 52900
  MOD_RES (1)..(1): Any amino acid

SEQ ID NO: 52927 - protein, 127 aa, Homo sapiens; identical to SEQ ID NO: 52898

SEQ ID NO: 52928 - protein, 306 aa, Homo sapiens; identical to SEQ ID NO: 52900
  MOD_RES (1)..(1): Any amino acid

SEQ ID NO: 52929 - protein, 162 aa, Homo sapiens; identical to SEQ ID NO: 52896

SEQ ID NO: 52930 - protein, 2089 aa, Homo sapiens; identical to SEQ ID NO: 52895

SEQ ID NO: 52931 - protein, 244 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPHRGGLLSCQKRCHCRG

SEQ ID NO: 52932 - protein, 127 aa, Homo sapiens; identical to SEQ ID NO: 52898

SEQ ID NO: 52933 - protein, 113 aa, Homo sapiens; identical to SEQ ID NO: 52897

SEQ ID NO: 52934 - protein, 1802 aa, Homo sapiens; identical to SEQ ID NO: 52917

SEQ ID NO: 52935 - protein, 244 aa, Homo sapiens; identical to SEQ ID NO: 52931

SEQ ID NO: 52936 - protein, 1802 aa, Homo sapiens; identical to SEQ ID NO: 52917

SEQ ID NO: 52937 - protein, 244 aa, Homo sapiens; identical to SEQ ID NO: 52931

SEQ ID NO: 52938 - protein, 244 aa, Homo sapiens; identical to SEQ ID NO: 52931

SEQ ID NO: 52939 - protein, 245 aa, Homo sapiens; identical to SEQ ID NO: 52920

SEQ ID NO: 52940 - protein, 1825 aa, Homo sapiens; identical to SEQ ID NO: 52894

SEQ ID NO: 52941 - protein, 245 aa, Homo sapiens; identical to SEQ ID NO: 52920

SEQ ID NO: 52942 - protein, 1802 aa, Homo sapiens; identical to SEQ ID NO: 52917

SEQ ID NO: 52943 - protein, 245 aa, Homo sapiens; identical to SEQ ID NO: 52920

SEQ ID NO: 52944 - protein, 1802 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILRPPKVLSPGVSHRLRDQELILFADLLCQYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEAVQSMEDEPTQAFMLTPPQELGPSHCSFQTTGTLDEPWEVLATQPFCLRESEDSETQPFDTHLEAYGPCLSPPRAIPGDQHPESPVHTEPMGIQGRGRQTVDKVMGIPKETAERVGPERGPLERETEKLLPERQTDVTGEEELTKGKQDREQKQLLARDTQRQESDKNGESASPERDRESLKVEIETSEEIQEKQVQKQTLPSKAFEREVERPVANRECDPAELEEKVPKVILERDTQRGEPEGGSQDQKGQASSPTPEPGVGAGDLPGPTSAPVPSGSQSGGRGSPVSPRRHQKGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPALQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 52945 - protein, 1825 aa, Homo sapiens; identical to SEQ ID NO: 52894

SEQ ID NO: 52946 - protein, 1655 aa, Homo sapiens; identical to SEQ ID NO: 52906

SEQ ID NO: 52947 - protein, 1655 aa, Homo sapiens
MYHRLDVSLPFVSRGPLTVEETPRVQGETQPQRLLLAEDSEEEVDFLSERRMVKKSRTTSSSVIVPESDEEGHSPVLGGLGPPFAFNLNSDTDVEEGQQPATEEASSAARRGATVEAKQSEAEVVTEIQLEKDQPLVKERDNDTKVKRGAGNGVVPAGVILERSQPPGEDSDTDVDDDSRPPGRPAEVHLERAQPFGFIDSDTDAEEERIPATPVVIPMKKRKIFHGVGTRGPGAPGLAHLQESQAGSDTDVEEGKAPQAVPLEKSQASMVINSDTDDEEEVSAALTLAHLKESQPAIWNRDAEEDMPQRVVLLQRSQTTTERDSDTDVEEEELPVENREAVLKDHTKIRALVRAHSEKDQPPFGDSDDSVEADKSSPGIHLERSQASTTVDINTQVEKEVPPGSAIIHIKKHQVSVEGTNQTDVKAVGGPAKLLVVSLEEAWPLHGDCETDAEEGTSLTASVVADVRKSQLPAEGDAGAEWAAAVLKQERAHEVGAQGGPPVAQVEQDLPISRENLTDLVVDTDTLGESTQPQREGAQVPTGREREQHVGGTKDSEDNYGDSEDLDLQATQCFLENQGLEVQSMEDEPTQAFMLTPPQELGPSHCSFQTTGLLNCKMPPAEKASRIRAAEKVSRGDQESPDACLPPTVPEAPAPPQKPLNSQSQKHLAPPPLLSPLLPSIKPTVRKTRQDGSQEAPEAPLSSELEPFHPKPKIRTRKSSRMTPFPATSAAPEPHPSTSTAQPVTPKPTSQATRSRTNRSSVKTPEPVVPTAPELQPSTSTDQPVTSEPTSQVTRGRKSRSSVKTPETVVPTALELQPSTSTDRPVTSEPTSQATRGRKNRSSVKTPEPVVPTAPELQPSTSTDQPVTSEPTYQATRGRKNRSSVKTPEPVVPTAPELRPSTSTDRPVTPKPTSRTTRSRTNMSSVKNPESTVPIAPELPPSTSTEQPVTPEPTSRATRGRKNRSSGKTPETLVPTAPKLEPSTSTDQPVTPEPTSQATRGRTNRSSVKTPETVVPTAPELQPSTSTDQPVTPEPTSQATRGRTDRSSVKTPETVVPTAPELQASASTDQPVTSEPTSRTTRGRKNRSSVKTPETVVPAAPALQPSTSTDQPVTPEPTSRATRGRTNRSSVKTPESIVPIAPELQPSTSRNQLVTPEPTSRATRCRTNRSSVKTPEPVVPTAPEPHPTTSTDQPVTPKLTSRATRRKTNRSSVKTPKPVEPAASDLEPFTPTDQSVTPEAIAQGGQSKTLRSSTVRAMPVPTTPEFQSPVTTDQPISPEPITQPSCIKRQRAAGNPGSLAAPIDHKPCSAPLEPKSQASRNQRWGAVRAAESLTAIPEPASPQLLETPIHASQIQKVEPAGRSRFTPELQPKASQSRKRSLATMDSPPHQKQPQRGEVSQKTVIIKEEEEDTAEKPGKEEDVVTPKPGKRKRDQAEEEPNRIPSRSLRRTKLNQESTAPKVLFTGVVDARGERAVLALGGSLAGSAAEASHLVTDRIRRTVKFLCALGRGIPILSLDWLHQSRKAGFFLPPDEYVVTDPEQEKNFGFSLQDALSRARERRLLEGYEIYVTPGVQPPPPQMGEIISCCGGTYLPSMPRSYKPQRVVITCPQDFPHCSIPLRVGLPLLSPEFLLTGVLKQEAKPEAFVLSPLEMSST

SEQ ID NO: 52948 - protein, 221 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILSSSLPPPQTSLLPLSLRLRLLGEEQIDPLSRLLKQLSPQPLSYRLPPPQTSLSPLSPHLGPLGEEKIGPLSRPLKQLCPQPLSSSLPPPQTNLSPLSPHLGPLGAGQIGPLSRPLNQLSL

SEQ ID NO: 52949 - protein, 221 aa, Homo sapiens; identical to SEQ ID NO: 52948

SEQ ID NO: 52950 - protein, 245 aa, Homo sapiens; identical to SEQ ID NO: 52920

SEQ ID NO: 52951 - protein, 1655 aa, Homo sapiens; identical to SEQ ID NO: 52906

SEQ ID NO: 52952 - protein, 1825 aa, Homo sapiens; identical to SEQ ID NO: 52894

SEQ ID NO: 52953 - protein, 1655 aa, Homo sapiens; identical to SEQ ID NO: 52906

SEQ ID NO: 52954 - protein, 1655 aa, Homo sapiens; identical to SEQ ID NO: 52906

SEQ ID NO: 52955 - protein, 244 aa, Homo sapiens; identical to SEQ ID NO: 52931

SEQ ID NO: 52956 - protein, 1802 aa, Homo sapiens; identical to SEQ ID NO: 52917

SEQ ID NO: 52957 - protein, 1655 aa, Homo sapiens; identical to SEQ ID NO: 52906

SEQ ID NO: 52958 - protein, 1802 aa, Homo sapiens; identical to SEQ ID NO: 52917

SEQ ID NO: 52959 - protein, 221 aa, Homo sapiens
MEDTQAIDWDVEEEEETEQSSESLRCNVEPVGRLHIFSGAHGPEKDFPLHLGKNVVGRMPDCSVALPFPSISKQHAEIEILAWDKAPILRDCGSLNGTQILSSSLPPPQTSLLPLSLRLRLLGEEQIDPLSRLLKQLSPQPLSYRLPPPQTSLSPLSPHLGPLGEEKIGPLSRPLKQLCPQPLRSSLPPPQTNLSPLSPHLGPLGAGQIGPLSRPLNQLSL

SEQ ID NO: 52960 - protein, 221 aa, Homo sapiens; identical to SEQ ID NO: 52948

SEQ ID NO: 52961 - protein, 245 aa, Homo sapiens; identical to SEQ ID NO: 52920

SEQ ID NO: 52962 - protein, 1825 aa, Homo sapiens; identical to SEQ ID NO: 52894

SEQ ID NO: 52963 - protein, 244 aa, Homo sapiens; identical to SEQ ID NO: 52931

SEQ ID NO: 52964 - protein, 244 aa, Homo sapiens; identical to SEQ ID NO: 52931

SEQ ID NO: 52965 - protein, 221 aa, Homo sapiens; identical to SEQ ID NO: 52948

SEQ ID NO: 52966 - protein, 221 aa, Homo sapiens; identical to SEQ ID NO: 52948

SEQ ID NO: 52967 - protein, 1825 aa, Homo sapiens; identical to SEQ ID NO: 52894

SEQ ID NO: 52968 - protein, 245 aa, Homo sapiens; identical to SEQ ID NO: 52920

SEQ ID NO: 52969 - protein, 781 aa, Homo sapiens
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 52970 - protein, 601 aa, Homo sapiens
MAKTPSDHLLSTLEELVPYDFEKFKFKLQNTSVQKEHSRIPRSQIQRARPVKMATLLVTYYGEEYAVQLTLQVLRAINQRLLAEELHRAAIQDMGSCYVAQVGLELLISNNPPIFASETAGITGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 52971 - protein, 412 aa, Homo sapiens
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNDHSPQHGLGSWEERDYTQHSMQGPKQGVPCFLVVRTV

SEQ ID NO: 52972 - protein, 570 aa, Homo sapiens
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKTAWILGACKTSISRKGNMTLSPENGYWVVIMMKENEYQASSVPPTRLLIKEPPKRVGIFVDYRVGSISFYNVTARSHIYTFASCSFSGPLQPIFSPGTRDGGKNTAPLTICPVGGQGPD

SEQ ID NO: 52973 - protein, 402 aa, Homo sapiens
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNGESSGNGVCWPGVVAVFPCAVDLRGPI

SEQ ID NO: 52974 - protein, 445 aa, Homo sapiens
MAKTPSDHLLSTLEELVPYDFEKFKFKLQNTSVQKEHSRIPRSQIQRARPVKMATLLVTYYGEEYAVQLTLQVLRAINQRLLAEELHRAAIQGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNDHSPQHGLGSWEERDYTQHSMQGPKQGVPCLSLLSGQCNLAPLNANAQDFFPYLIFLRSSGADWRSGTCC

SEQ ID NO: 52975 - protein, 688 aa, Homo sapiens
MAKTPSDHLLSTLEELVPYDFEKFKFKLQNTSVQKEHSRIPRSQIQRARPVKMATLLVTYYGEEYAVQLTLQVLRAINQRLLAEELHRAAIQEYSTQENGTDDSAASSSLGENKPRSLKTPDHPEGNEGNGPRPYGGGAASLRCSQPEAGRGLSRKPLSKRREKASEGLDAQGKPRTRSPALPGGRSPGPCRALEGGQAEVRLRRNASSAGRLQGLAGGAPGQKECRPFEVYLPSGKMRPRSLEVTISTGEKAPANPEILLTLEEKTAANLDSATEPRARPTPDGGASADLKEGPGNPEHSVTGRPPDTAASPRCHAQEGDPVDGTCVRDSCSFPEAVSGHPQASGSRSPGCPRCQDSHERKSPGSLSPQPLPQCKRHLKQVQLLFCEDHDEPICLICSLSQEHQGHRVRPIEEVALEHKKKIQKQLEHLKKLRKSGEEQRSYGEEKAVSFLKQTEALKQRVQRKLEQVYYFLEQQEHFFVASLEDVGQMVGQIRKAYDTRVSQDIALLDALIGELEAKECQSEWELLQDIGDILHRAKTVPVPEKWTTPQEIKQKIQLLHQKSEFVEKSTKYFSETLRSEMEMFNVPELIGAQAHAVNVILDAETAYPNLIFSDDLKSVRLGNKWERLPDGPQRFDSCIIVLGSPSFLSGRRYWEVEVGDKRFSCLSLRSSWDYRRPPPCPANFLHF

SEQ ID NO: 52976 - protein, 931 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 52977 - protein, 798 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGGNPRNFSRFQGAAIPAREGEAIPEDSLWVPPGSTAITFC

SEQ ID NO: 52978 - protein, 881 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQQSQPKSASEKSQRSKKAKELKPKVKKLKYHQYIPPDQKQDRGAPPMDSSYAKILQQQQLFLQLQILNQQQQQHHNYQAILPAPPKSAGEALGSSGTPPVRSLSTTNSSSSSGAPGPCGLARQNSTSLTGKPGALPANLDDMKVAELKQELKLRSLPVSGTKTELIERLRAYQDQISPVPGAPKAPAATSILHKAGEVVVAFPAARLSTGPALVAAGLAPAEVVVATVASSGVVKFGSTGSTPPVSPTPSERSLLSTGDENSTPGDTFGEMVTSPLTQLTLQASPLQILVKEEGPRAGSCCLSPGGRAELEGRDKDQMLQEKDKQIEALTRMLRQKQQLVERLKLQLEQEKRAQQPAPAPAPLGTPVKQENSFSSCQLSQQPLGPAHPFNPSLAAPATNHIDPCAVAPGPPSVVVKQEALQPEPEPVPAPQLLLGPQGPSLIKGVAPPTLITDSTGTHLVLTVTNKNADSPGLSSGSPQQPSSQPGSPAPAPSAQMDLEHPLQPLFGTPTSLLKKEPPGYEEAMSQQPKQQENGSSSQQMDDLFDILIQSGEISADFKEPPSLPGKEKPSPKTVCGSPLAAQPSPSAELPQAAPPPPGSPSLPGRLEDFLESSTGLPLLTSGHDGPEPLSLIDDLHSQMLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 52979 - protein, 931 aa, Homo sapiens; identical to SEQ ID NO: 52976

SEQ ID NO: 52980 - protein, 85 aa, Homo sapiens
MLSSTAILDHPPSPMDTSELHFVPEPSSTMGLDLADGHLDSMDWLELSSGGPVLSLAPLSTTAPSLFSTDFLDGHDLQLHWDSCL

SEQ ID NO: 52981 - protein, 507 aa, Homo sapiens
MAGRGSLVSWRAFHGCDSAEELPRVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 52982 - protein, 466 aa, Homo sapiens
MPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 52983 - protein, 508 aa, Homo sapiens
MQGHFPAERREGRPRRGTRGQQQLLVSPRFLRAWHPPPVSARMPTRRWAPGTQCITKCEHTRPKPGELAFRKGDVVTILEACENKSWYRVKHHTSGQEGLLAAGALREREALSADPKLSLMPWFHGKISGQEAVQQLQPPEDGLFLVRESARHPGDYVLCVSFGRDVIHYRVLHRDGHLTIDEAVFFCNLMDMVEHYSKDKGAICTKLVRPKRKHGTKSAEEELARAGWLLNLQHLTLGAQIGEGEFGAVLQGEYLGQKVAVKNIKCDVTAQAFLDETAVMTKMQHENLVRLLGVILHQGLYIVMEHVSKGNLVNFLRTRGRALVNTAQLLQFSLHVAEGMEYLESKKLVHRDLAARNILVSEDLVAKVSDFGLAKAERKGLDSSRLPVKWTAPEALKHGKFTSKSDVWSFGVLLWEVFSYGRAPYPKMSLKEVSEAVEKGYRMEPPEGCPGPVHVLMSSCWEAEPARRPPFRKLAEKLARELRSAGAPASVSGQDADGSTSPRSQEP

SEQ ID NO: 52984 - protein, 377 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 52985 - protein, 377 aa, Homo sapiens; identical to SEQ ID NO: 52984

SEQ ID NO: 52986 - protein, 347 aa, Homo sapiens
MTQEPFREELAYDRMPTLERGRQDPASYAPDAKPSDLQLSKRLPPCFSHKTWVFSVLMGCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 52987 - protein, 223 aa, Homo sapiens
MTQEPFREELAYDRMPTLERGRQDPASYAPDAKPSDLQLSKRLPPCFSHKTWVFSVLMGCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECP

SEQ ID NO: 52988 - protein, 325 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSINFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 52989 - protein, 298 aa, Homo sapiens
MDYLRCAAGSCIPSAIVSFTVSRRNANVIPNFQILFVSTFAVTTTCLIWFGCKLVLNPSAININFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 52990 - protein, 343 aa, Homo sapiens
MTQEPFREELAYDRMPTLERGRQDPASYAPDAKPSDLQLSKRLPPCFSHKTWVFSVLMGSCLLVTSGFSLYLGNVFPAEMDYLRCAAGSCIPSAIVSFTVSRRNANVINFNLILLLLLELLMAATVIIAARSSEEDCKKKKGSMSDSANILDEVPFPARVLKSYSVVEVIAGISAVLGGIIALNVDDSVSGPHLSVTFFWILVACFPSAIASHVAAECPSKCLVEVLIAISSLTSPLLFTASGYLSFSIMRIVEMFKDYPPAIKPSYDVLLLLLLLVLLLQAGLNTGTAIQCVRFKVSARLQGASWDTQNGPQERLAGEVARSPLKEFDKEKAWRAVVVQMAQ

SEQ ID NO: 52991 - protein, 88 aa, Homo sapiens
MASSDVKPKSVSHAKKWSEEIENLYRFQQAGYRDETEYRQVKQVSMVDRWPETGYVKKLQRRDNTFYYYNKQRECDDKEVHKVKIYAY

SEQ ID NO: 52992 - protein, 88 aa, Homo sapiens; identical to SEQ ID NO: 52991

SEQ ID NO: 52993 - protein, 495 aa, Homo sapiens
MGSKRRNLSCSERHQKLVDENYCKKLHVQALKNVNSQIRNQMVQNENDNRVQRKQFLRLLQNEQFELDMEEAIQKAEENKRLKELQLKQEEKLAMELAKLKHESLKDEKMRQQVRENSIELRELEKKLKAAYMNKERAAQIAEKDAIKYEQMKRDAEIAKTMMEEHKRIIKEENAAEDKRNKAKAQYYLDLEKQLEEQEKKKQEAYEQLLKEKLMIDEIVRKIYEEDQLEKQQKLEKMNAMRRYIEEFQKEQALWRKKKREEMEEENRKIIEFANMQQQREEDRMAKVQENEEKRLQLQNALTQKLEEMLRQREDLEQVRQELYQEEQAEIYKSKLKEEAEKKLRKQKEMKQDFEEQMALKELVLQAAKEEEENFRKTMLAKFAEDDRIELMNAQKQRMKQLEHRRAVEKLIEERRQQFLADKQRELEEWQLQQRRQGFINAIIEEERLKLLKEHATNLLGYLPKGVFKKEDDIDLLGEEFRKVYQQRSEICEEK

SEQ ID NO: 52994 - protein, 390 aa, Homo sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 52995 - protein, 463 aa, Homo sapiens
MQYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGLQSMPGEYVARGGPMGVSMGQPSYTQPQMPPHPAQLRHGPPMHTYIPGHPHHPTVMMHGGPPHPGMPMSASSPTVLNTGDPTMSGQVMDIHAQ

SEQ ID NO: 52996 - protein, 253 aa, Homo sapiens
MIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGPPCIRTFLDTLTTQQ

SEQ ID NO: 52997 - protein, 465 aa, Homo sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGLQSMPGEYVARGGPMGVSMGQPSYTQPQMPPHPAQLRHGPPMHTYIPGHPHHPTVMMHGGPPHPGMPMSASSPTVLNTGDPTMSGQVMDIHAQ

SEQ ID NO: 52998 - protein, 140 aa, Homo sapiens
MKKNGDEKSPLGTEIMMTRHLLVQEEPQALPAVATRHTVGTTAVSKHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 52999 - protein, 220 aa, Homo sapiens
MQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQAPLPF

SEQ ID NO: 53000 - protein, 179 aa, Homo sapiens
MKSLLTFYKCGSELLPAAVWSAGGSPSLFSDLKSKKGKKFSRDHIEVTISNCGVNGNAKGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMG

SEQ ID NO: 53001 - protein, 325 aa, Homo sapiens
MAQGLRLQGSRRKGRHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAVSQGTPYNPDGQPMGGFVMDGQQHMGIRAPGPMSGMGMNMGMEGQWHYM

SEQ ID NO: 53002 - protein, 370 aa, Homo sapiens
MAQRYDDLPHYGGMDGVGIPSTMYGDPHAARSMQPVHHLNHGPPLHSHQYPHTAHTNAMAPSMGSSVNDALKRDKDAIYGHPLFPLLALIFEKCELATCTPREPGVAGGDVCSSESFNEDIAVFAKQIRAEKPLFSSNPELDNLMIQAIQVLRFHLLELEKVHELCDNFCHRYISCLKGKMPIDLVIDDREGGSKSDSEDITRSANLTDQPSWNRDHDDTASTRSGGTPGPSSGGHTSHSGDNSSEQGDGLDNSVASPSTGDDDDPDKDKKRHKKRGIFPKVATNIMRAWLFQHLTHPYPSEEQKKQLAQDTGLTILQVNNWFINARRRIVQPMIDQSNRAGKSPIVTVFKSRKRKPSSSHSPGGPLPGK

SEQ ID NO: 53003 - protein, 255 aa, Homo sapiens
MIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 53004 - protein, 470 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 53005 - protein, 381 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 53006 - protein, 470 aa, Homo sapiens; identical to SEQ ID NO: 53004

SEQ ID NO: 53007 - protein, 306 aa, Homo sapiens
MALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 53008 - protein, 306 aa, Homo sapiens; identical to SEQ ID NO: 53007

SEQ ID NO: 53009 - protein, 401 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 53010 - protein, 394 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAVSQGAAYSPEGQPMGSFVLDGQQHMGIRPAGPMSGMGMNMGMDGQWHYM

SEQ ID NO: 53011 - protein, 238 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQ

SEQ ID NO: 53012 - protein, 79 aa, Homo sapiens
MALVFEKCELATCTPREPGVAGGDVCSSDSFNEDIAVFAKQVRAEKPLFSSNPELDNLMIQAIQVLRFHLLELEKVSRK

SEQ ID NO: 53013 - protein, 388 aa, Homo sapiens
MDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGPMSGMGMNMGMDGQWHYM

SEQ ID NO: 53014 - protein, 394 aa, Homo sapiens; identical to SEQ ID NO: 53010

SEQ ID NO: 53015 - protein, 477 aa, Homo sapiens
MAQRYDELPHYGGMDGVGVPASMYGDPHAPRPIPPVHHLNHGPPLHATQHYGAHAPHPNVMPASMGSAVNDALKRDKDAIYGHPLFPLLALVFEKCELATCTPREPGVAGGDVCSSDSFNEDIAVFAKQVRAEKPLFSSNPELDNLMIQAIQVLRFHLLELEKVHELCDNFCHRYISCLKGKMPIDLVIDERDGSSKSDHEELSGSSTNLADHNPSSWRDHDDATSTHSAGTPGPSSGGHASQSGDNSSEQGDGLDNSVASPGTGDDDDPDKDKKRQKKRGIFPKVATNIMRAWLFQHLTHPYPSEEQKKQLAQDTGLTILQVNNWFINARRRIVQPMIDQSNRAGFLLDPSVSQGAAYSPEGQPMGSFVLDGQQHMGIRPAGLQSMPGDYVSQGGPMGMSMAQPSYTPPQMTPHPTQLRHGPPMHSYLPSHPHHPAMMMHGGPPTHPGMTMSAQSPTMLNSVDPNVGGQVMDIHAQ

SEQ ID NO: 53016 - protein, 477 aa, Homo sapiens; identical to SEQ ID NO: 53015

SEQ ID NO: 53017 - protein, 118 aa, Homo sapiens
MPREDAHFIYGYPKKGHGHSYTTAEEAAGIGILTVILGVLLLIGCWYCRRRNGYRALMDKSLHVGTQCALTRRCPQEGFDHRDSKVSLQEKNCEPVVPNAPPAYEKLSAEQSPPPYSP

SEQ ID NO: 53018 - protein, 118 aa, Homo sapiens; identical to SEQ ID NO: 53017

SEQ ID NO: 53019 - protein, 118 aa, Homo sapiens; identical to SEQ ID NO: 53017

SEQ ID NO: 53020 - protein, 422 aa, Homo sapiens
MSVGAMKKGVGRAVGLGGGSGCQATEEDPLPNCGACAPGQGGRRWRLPQPAWVEGSSARLWEQATGTGWMDLEASLLPTGPNASNTSDGPDNLTSAGSPPRTGSISYINIIMPSVFGTICLLGIIGNSTVIFAVVKKSKLHWCNNVPDIFIINLSVVDLLFLLGMPFMIHQLMGNGVWHFGETMCTLITAMDANSQFTSTYILTAMAIDRYLATVHPISSTKFRKPSVATLVICLLWALSFISITPVWLYARLIPFPGGAVGCGIRLPNPDTDLYWFTLYQFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 53021 - protein, 296 aa, Homo sapiens
MSVGAMKKGVGRAVGLGGGSGCQATEEDPLPNCGACAPGQGGRRWRLPQPAWVEGSSARLWEQATGTGWMDLEASLLPTGPNASNTSDGPDNLTSAGSPPRTGSISYINIIMPSVFGTICLLGIIGNSTVIFAVVKKSKLHWCNNVPDIFIINLSFFLAFALPFVVITAAYVRILQRMTSSVAPASQRSIRLRTKRVTRTAIAICLVFFVCWAPYYVLQLTQLSISRPTLTFVYLYNAAISLGYANSCLNPFVYIVLCETFRKRLVLSVKPAAQGQLRAVSNAQTADEERTESKGT

SEQ ID NO: 53022 - protein, 340 aa, Homo sapiens
MNPFHASCWNTSAELLNKSWNKEFAYQTASVVDTVILPSMIGIICSTGLVGNILIVFTIIRSRKKTVPDIYICNLAVADLVHIVGMPFLIHQWARGGEWVFGGPLCTIITSLDTCNQFACSAIMTVMSVDRYFALVQPFRLTRWRTRYKTIRINLGLWAASFILALPVWVYSKVIKFKDGVESCAFDLTSPDDVLWYTLYLTITTFFFPLPLILVCYILILCYTWEMYQQNKDARCCNPSVPKQRVMKLTKMVLVLVVVFILSAAPYHVIQLVNLQMEQPTLAFYVGYYLSICLSYASSSINPFLYILLSGNFQKRLPQIQRRATEKEINNMGNTLKSHF

SEQ ID NO: 53023 - protein, 340 aa, Homo sapiens; identical to SEQ ID NO: 53022

SEQ ID NO: 53024 - protein, 340 aa, Homo sapiens; identical to SEQ ID NO: 53022

SEQ ID NO: 53025 - protein, 172 aa, Homo sapiens
MANGTNASAPYYSYEYYLDYLDLIPVDEKKLKAHKHSIVIAFWVSLAAFVVLLFLILLYMSWSASPQMRNSPKHHQTCPWSHGLNLHLCIQKCLPCHREPLATSQAQASSVEPGSRTGPDQPLRQESSSTLPLGGFQTHPTLLWELTLNGGPLVRSKPSEPPPGDRTSQLQS

SEQ ID NO: 53026 - protein, 102 aa, Homo sapiens
MANGTNASAPYYSYEYYLDYLDLIPVDEKKLKAHKHSIVIAFWVSLAAFVVLLFLILLYMSWSASPQMSFNTDESLLHSEVLPQTRAISCDELQAPREEGAA

SEQ ID NO: 53027 - protein, 172 aa, Homo sapiens; identical to SEQ ID NO: 53025

SEQ ID NO: 53028 - protein, 102 aa, Homo sapiens; identical to SEQ ID NO: 53026

SEQ ID NO: 53029 - protein, 369 aa, Homo sapiens
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIRNYEDHFPLLFSEASECMLLVFGIDVKEVDPTGHSFVLVTSLGLTYDGMLSDVQSMPKTGILILILSIVFIEGYCTPEEVIWEALNMMGLYDGMEHLIYGEPRKLLTQDWVQENYLEYRQVPGSDPARYEFLWGPRAHAEIRKMSLLKFLAKVNGSDPRSFPLWYEEALKDEEERAQDRIATTDDTTAMASASSSATGSFSYPE

SEQ ID NO: 53030 - protein, 369 aa, Homo sapiens; identical to SEQ ID NO: 53029

SEQ ID NO: 53031 - protein, 161 aa, Homo sapiens
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEIL

SEQ ID NO: 53032 - protein, 190 aa, Homo sapiens
MPRAPKRQRCMPEEDLQSQSETQGLEGAQAPLAVEEDASSSTSTSSSFPSSFPSSSSSSSSSCYPLIPSTPEEVSADDETPNPPQSAQIACSSPSVVASLPLDQSDEGSSSQKEESPSTLQVLPDSESLPRSEIDEKVTDLVQFLLFKYQMKEPITKAEILESVIRNYEDHFPLLFSEASECMLLVFGID

SEQ ID NO: 53033 - protein, 400 aa, Homo sapiens
MSKVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 53034 - protein, 429 aa, Homo sapiens
METQFRRGGLGCSPASIKRKKKREDSGDFGLQVSTMFSEDDFQSTERAPYGPQLQWSQDLPRVQVFREQANLEDRSPRRTQRITGGEQVLWGPITQIFPTVRPADLTRVIMPLEQRSQHCKPEEGLQAQEEDLGLVGAQALQAEEQEAAFFSSTLNVGTLEELPAAESPSPPQSPQEESFSPTAMDAIFGSLSDEGSGSQEKEGPSTSPDLIDPESFSQDILHDKIIDLVHLLLRKYRVKGLITKAEMLGSVIKNYEDYFPEIFREASVCMQLLFGIDVKEVDPTSHSYVLVTSLNLSYDGIQCNEQSMPKSGLLIIVLGVIFMEGNCIPEEVMWEVLSIMGVYAGREHFLFGEPKRLLTQNWVQEKYLVYRQVPGTDPACYEFLWGPRAHAETSKMKVLEYIANANGRDPTSYPSLYEDALREEGEGV

SEQ ID NO: 53035 - protein, 314 aa, Homo sapiens
MPLEQRSQHCKPEEGLEAQGEALGLVGAQAPATEEQETASSSSTLVEVTLREVPAAESPSPPHSPQGASTLPTTINYTLWSQSDEGSSNEEQEGPSTFPDLETSFQVALSRKMAELVHFLLLKYRAREPFTKAEMLGSVIRNFQDFFPVIFSKASEYLQLVFGIEVVEVVRIGHLYILVTCLGLSYDGLLGDNQIVPKTGLLIIVLAIIAKEGDCAPEEKIWEELSVLEASDGREDSVFAHPRKLLTQDLVQENYLEYRQVPGSDPACYEFLWGPRALVETSYVKVLHHLLKISGGPHISYPPLHEWAFREGEE

SEQ ID NO: 53036 - protein, 314 aa, Homo sapiens; identical to SEQ ID NO: 53035

SEQ ID NO: 53037 - protein, 314 aa, Homo sapiens; identical to SEQ ID NO: 53035

SEQ ID NO: 53038 - protein, 314 aa, Homo sapiens
MPLEQRSQHCKPEEGLEARGEALGLVGAQAPATEEQQTASSSSTLVEVTLGEVPAADSPSPPHSPQGASSFSTTINYTLWRQSDEGSSNQEEEGPRMFPDLESEFQAAISRKMVELVHFLLLKYRAREPVTKAEMLESVLRNCQDFFPVIFSKASEYLQLVFGIEVVEVVPISHLYILVTCLGLSYDGLLGDNQVMPKTGLLIIVLAIIAIEGDCAPEEKIWEELSMLEVFEGREDSVFAHPRKLLMQDLVQENYLEYRQVPGSDPACYEFLWGPRALIETSYVKVLHHTLKIGGEPHISYPPLHERALREGEE

SEQ ID NO: 53039 - protein, 314 aa, Homo sapiens; identical to SEQ ID NO: 53038

SEQ ID NO: 53040 - protein, 314 aa, Homo sapiens; identical to SEQ ID NO: 53038

SEQ ID NO: 53041 - protein, 314 aa, Homo sapiens; identical to SEQ ID NO: 53038

SEQ ID NO: 53042 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPKAGLLIIVLAIIAREGDCAPEEKIWEELSVLEVFEGREDSILGDPKKLLTQHFVQENYLEYRQVPGSDPACYEFLWGPRALVETSYVKVLHHMVKISGGPHISYPPLHEWVLREGEE

SEQ ID NO: 53043 - protein, 314 aa, Homo sapiens; identical to SEQ ID NO: 53042

SEQ ID NO: 53044 - protein, 198 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAELVHFLLLKYRAREPVTKAEMLGSVVGNWQYFFPVIFSKASSSLQLVFGIELMEVDPIGHLYIFATCLGLSYDGLLGDNQIMPK

SEQ ID NO: 53045 - protein, 317 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYGEPRKLLTQDWVQENYLEYRQVPGSNPARYEFLWGPRALAETSYVKVLEHVVRVNARVRIAYPSLREAALLEEEEGV

SEQ ID NO: 53046 - protein, 317 aa, Homo sapiens; identical to SEQ ID NO: 53045

SEQ ID NO: 53047 - protein, 317 aa, Homo sapiens; identical to SEQ ID NO: 53045

SEQ ID NO: 53048 - protein, 317 aa, Homo sapiens; identical to SEQ ID NO: 53045

SEQ ID NO: 53049 - protein, 317 aa, Homo sapiens; identical to SEQ ID NO: 53045

SEQ ID NO: 53050 - protein, 317 aa, Homo sapiens; identical to SEQ ID NO: 53045

SEQ ID NO: 53051 - protein, 317 aa, Homo sapiens; identical to SEQ ID NO: 53045

SEQ ID NO: 53052 - protein, 230 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMG

SEQ ID NO: 53053 - protein, 217 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSA

SEQ ID NO: 53054 - protein, 241 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDPASNTYTLVTCLGLSYDGLLGNNQIFPKTGLLIIVLGTIAMEGDSASEEEIWEELGVMGVYDGREHTVYG

SEQ ID NO: 53055 - protein, 172 aa, Homo sapiens
MSSEQKSQHCKPEEGVEAQEEALGLVGAQAPTTEEQEAAVSSSSPLVPGTLEEVPAAESAGPPQSPQGASALPTTISFTCWRQPNEGSSSQEEEGPSTSPDAESLFREALSNKVDELAHFLLRKYRAKELVTKAEMLERVIKNYKRCFPVIFGKASESLKMIFGIDVKEVDP

SEQ ID NO: 53056 - protein, 241 aa, Homo sapiens; identical to SEQ ID NO: 53054

SEQ ID NO: 53057 - protein, 241 aa, Homo sapiens; identical to SEQ ID NO: 53054

SEQ ID NO: 53058 - protein, 217 aa, Homo sapiens; identical to SEQ ID NO: 53053

SEQ ID NO: 53059 - protein, 241 aa, Homo sapiens; identical to SEQ ID NO: 53054

SEQ ID NO: 53060 - protein, 314 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGREDSIFGDPKKLLTQYFVQENYLEYRQVPGSDPACYEFLWGPRALIETSYVKVLHHMVKISGGPRISYPLLHEWALREGEE

SEQ ID NO: 53061 - protein, 201 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGF

SEQ ID NO: 53062 - protein, 235 aa, Homo sapiens
MPLEQRSQHCKPEEGLEARGEALGLVGAQAPATEEQEAASSSSTLVEVTLGEVPAAESPDPPQSPQGASSLPTTMNYPLWSQSYEDSSNQEEEGPSTFPDLESEFQAALSRKVAKLVHFLLLKYRAREPVTKAEMLGSVVGNWQYFFPVIFSKASDSLQLVFGIELMEVDPIGHVYIFATCLGLSYDGLLGDNQIMPKTGFLIIILAIIAKEGDCAPEEKIWEELSVLEVFEGRE

SEQ ID NO: 53063 - protein, 318 aa, Homo sapiens
MLLGQKSQRYKAEEGLQAQGEAPGLMDVQIPTAEEQKAASSSSTLIMGTLEEVTDSGSPSPPQSPEGASSSLTVTDSTLWSQSDEGSSSNEEEGPSTSPDPAHLESLFREALDEKVAELVRFLLRKYQIKEPVTKAEMLESVIKNYKNHFPDIFSKASECMQVIFGIDVKEVDPAGHSYILVTCLGLSYDGLLGDDQSTPKTGLLIIVLGMILMEGSRAPEEAIWEALSVMGLYDGREHSVYWKLRKLLTQEWVQENYLEYRQAPGSDPVRYEFLWGPRALAETSYVKVLEHVVRVNARVRISYPSLHEEALGEEKGV

SEQ ID NO: 53064 - protein, 318 aa, Homo sapiens; identical to SEQ ID NO: 53063

SEQ ID NO: 53065 - protein, 318 aa, Homo sapiens; identical to SEQ ID NO: 53063

SEQ ID NO: 53066 - protein, 315 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLGEEQEGV

SEQ ID NO: 53067 - protein, 114 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAE

SEQ ID NO: 53068 - protein, 309 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMPKAALLIIVLGVILTKDNCAPEEVIWEALSVMGVYVGKEHMFYGEPRKLLTQDWVQENYLEYRQVPGSDPAHYEFLWGSKAHAETSYEKVINYLVMLNAREPICYPSLYEEVLG

SEQ ID NO: 53069 - protein, 196 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDPAQLEFMFQEALKLKVAELVHFLLHKYRVKEPVTKAEMLESVIKNYKRYFPVIFGKASEFMQVIFGTDVKEVDPAGHSYILVTALGLSCDSMLGDGHSMP

SEQ ID NO: 53070 - protein, 97 aa, Homo sapiens
MSLEQRSPHCKPDEDLEAQGEDLGLMGAQEPTGEEEETTSSSDSKEEEVSAAGSSSPPQSPQGGASSSISVYYTLWSQFDEGSSSQEEEEPSSSVDP

SEQ ID NO: 53071 - protein, 315 aa, Homo sapiens; identical to SEQ ID NO: 53066

SEQ ID NO: 53072 - protein, 347 aa, Homo sapiens
MPRGQKSKLRAREKRRKAREETQGLKVAHATAAEKEECPSSSPVLGDTPTSSPAAGIPQKPQGAPPTTTAAAAVSCTESDEGAKCQGEENASFSQATTSTESSVKDPVAWEAGMLMHFILRKYKMREPIMKADMLKVVDEKYKDHFTEILNGASRRLELVFGLDLKEDNPSGHTYTLVSKLNLTNDGNLSNDWDFPRNGLLMPLLGVIFLKGNSATEEEIWKFMNVLGAYDGEEHLIYGEPRKFITQDLVQEKYLKYEQVPNSDPPRYQFLWGPRAYAETTKMKVLEFLAKMNGATPRDFPSHYEEALRDEEERAQVRSSVRARRRTTATTFRARSRAPFSRSSHPM

SEQ ID NO: 53073 - protein, 347 aa, Homo sapiens; identical to SEQ ID NO: 53072

SEQ ID NO: 53074 - protein, 347 aa, Homo sapiens; identical to SEQ ID NO: 53072

SEQ ID NO: 53075 - protein, 347 aa, Homo sapiens
MPRGQKSKLRAREKRRQARGGLEDLIDALDILEEEEESPPSASACLKDVFQSSLDGASNNPHGLREAQSTSTSATAASHTRHPEGVNDQMEERPICTQDLEATDSFPRGPVDEKVIILVHYLLYKYQMKEPITKADMLRNVTQMSKSQFPVILSRASEHLELIFGLDLKEVEPNKHIYVLVNKLDLGCDAKLSDETGVPKTGLLMTVLGIIFTNGNCVAEEEVWKVFNTMGLYDGIEHFMFGEPRKLLTKDLVKENYLEYQQVPNSDPPRYQFLWGPRAHAETSKMKVLEFLAKVNDTAPSEFSNWYTEALQDEEERARARVAAKARVSATAGARSKVKSSKSSQLQ

SEQ ID NO: 53076 - protein, 324 aa, Homo sapiens
MSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERARARI

SEQ ID NO: 53077 - protein, 324 aa, Homo sapiens; identical to SEQ ID NO: 53076

SEQ ID NO: 53078 - protein, 324 aa, Homo sapiens; identical to SEQ ID NO: 53076

SEQ ID NO: 53079 - protein, 324 aa, Homo sapiens; identical to SEQ ID NO: 53076

SEQ ID NO: 53080 - protein, 356 aa, Homo sapiens
MGTEAQPVVKAVILHCLPSCPHSCLLPPTRVIMSQDQESPRCTHDQHLQTFSETQSLEVAQVSKALEKTLLSSSHPLVPGKLKEAPAAKAESPLEVPQSFCSSSIAVTTTSSSESDEASSNQEEEDSPSSSEDTSDPRNVPADALDQKVAFLVNFMLHKCQMKKPITKADMLKIIIKDDESHFSEILLRASEHLEMIFGLDVVEVDPTTHCYGLFIKLGLTYDGMLSGEKGVPKTGLLIIVLGVIFMKGNRATEEEVWEVLNLTGVYSGKKHFIFGEPRMLITKDFVKEKYLEYQQVANSDPARYEFLWGPRAKAETSKMKVLEFVAKVHGSYPHSFPSQYAEALKEEEERARARI

SEQ ID NO: 53081 - protein, 331 aa, Homo sapiens
MPRGQASKRRAREKRRQARGEDQCLGGAQATAAEKEKLPSSSSPACQSPPQSFPNAGIPQESQRASYPSSPASAVSLTSSDEGAKGQKGESPNSFHGPSSSESTGRDLLNTKTGELVQFLLNKYIRKEPITREAMLKVINRKYKQHFPEILRRSTENVEVVFGLYLKEMDPSRQSYVLVGKLDFPNQGSLSDGGGFPLSGLLMVLLSTIFMHGNRATEEEMWECLNALGMYKGRKHFIYGEPQELVTKDLVREGYLEYQQVPSSDPPRYEFLWGPRARAETSKMKVLEFVAKLNDTVASTYKSRYEEALREEEEQARARAVARDSARARAS

SEQ ID NO: 53082 - protein, 336 aa, Homo sapiens
MPRGQASKRRAREKRRQARGEDQCLGGAQATAAEKEKLPSSSSPACQSPPQSFPNAGIPQESQRASYPSSPASAVSLTSSDEGAKGQKGESPNSFHGPSSSESTGRDLLNTKTGELVQFLLNKYIRKEPITREAMLKVINRKYKQHFPEILRRSTENVEVVFGLYLKEMDPSRQSYVLVGKLDFPNQGSLSDGGGFPLSGLLMVLLSTIFMHGNRATEEEMWECLNALGMYKGRKHFIYGEPQELVTKDLVREGYLEYQQVPSSDPPRYEFLWGPRARAETSKMKVLEFVAKLNDTVASTYKSRYEEALREEEEQARARAVARDSARARASRSFQP

SEQ ID NO: 53083 - protein, 336 aa, Homo sapiens; identical to SEQ ID NO: 53082

SEQ ID NO: 53084 - protein, 319 aa, Homo sapiens
MPRGQKSKLRAREKRRKARDETRGLNVPQVTEAEEEEAPCCSSSVSGGAASSSPAAGIPQEPQRAPTTAAAAAAGVSSTKSKKGAKSHQGEKNASSSQASTSTKSPSEDPLTRKSGSLVQFLLYKYKIKKSVTKGEMLKIVGKRFREHFPEILKKASEGLSVVFGLELNKVNPNGHTYTFIDKVDLTDEESLLSSWDFPRRKLLMPLLGVIFLNGNSATEEEIWEFLNMLGVYDGEEHSVFGEPWKLITKDLVQEKYLEYKQVPSSDPPRFQFLWGPRAYAETSKMKVLEFLAKVNGTTPCAFPTHYEEALKDEEKAGV

SEQ ID NO: 53085 - protein, 346 aa, Homo sapiens
MPRGQKSTLHAREKRQQTRGQTQDHQGAQITATNKKKVSFSSPLILGATIQKKSAGRSRSALKKPQRALSTTTSVDVSYKKSYKGANSKIEKKQSFSQGLSSTVQSRTDPLIMKTNMLVQFLMEMYKMKKPIMKADMLKIVQKSHKNCFPEILKKASFNMEVVFGVDLKKVDSTKDSYVLVSKMDLPNNGTVTRGRGFPKTGLLLNLLGVIFMKGNCATEEKIWEFLNKMRIYDGKKHFIFGEPRKLITQDLVKLKYLEYRQVPNSNPARYEFLWGPRAHAETSKMKVLEFWAKVNKTVPSAFQFWYEEALRDEEERVQAAAMLNDGSSAMGRKCSKAKASSSSHA

SEQ ID NO: 53086 - protein, 346 aa, Homo sapiens; identical to SEQ ID NO: 53085

SEQ ID NO: 53087 - protein, 346 aa, Homo sapiens
MPRGQKSKLRAREKRQRTRGQTQDLKVGQPTAAEKEESPSSSSSVLRDTASSSLAFGIPQEPQREPPTTSAAAAMSCTGSDKGDESQDEENASSSQASTSTERSLKDSLTRKTKMLVQFLLYKYKMKEPTTKAEMLKIISKKYKEHFPEIFRKVSQRTELVFGLALKEVNPTTHSYILVSMLGPNDGNQSSAWTLPRNGLLMPLLSVIFLNGNCAREEEIWEFLNMLGIYDGKRHLIFGEPRKLITQDLVQEKYLEYQQVPNSDPPRYQFLWGPRAHAETSKMKVLEFLAKVNDTTPNNFPLLYEEALRDEEERAGARPRVAARRGTTAMTSAYSRATSSSSSQPM

SEQ ID NO: 53088 - protein, 275 aa, Homo sapiens
MTSAGVFNAGSDERANSRDEEYPCSSEVSPSTESSCSNFINIKVGLLEQFLLYKFKMKQRILKEDMLKIVNPRYQNQFAEIHRRASEHIEVVFAVDLKEVNPTCHLYDLVSKLKLPNNGRIHVGKVLPKTGLLMTFLVVIFLKGNCANKEDTWKFLDMMQIYDGKKYYIYGEPRKLITQDFVRLTYLEYHQVPCSYPAHYQFLWGPRAYTETSKMKVLEYLAKVNDIAPGAFSSQYEEALQDEEESPSQRCSRNWHYCSGQDCLRAKFSSFSQPY

SEQ ID NO: 53089 - protein, 407 aa, Homo sapiens
MPRGHKSKLRTCEKRQETNGQPQGLTGPQATAEKQEESHSSSSSSRACLGDCRRSSDASIPQESQGVSPTGSPDAVVSYSKSDVAANGQDEKSPSTSRDASVPQESQGASPTGSPDAGVSGSKYDVAANGQDEKSPSTSHDVSVPQESQGASPTGSPDAGVSGSKYDVAAEGEDEESVSASQKAIIFKRLSKDAVKKKACTLAQFLQKKFEKKESILKADMLKCVRREYKPYFPQILNRTSQHLVVAFGVELKEMDSSGESYTLVSKLGLPSEGILSGDNALPKSGLLMSLLVVIFMNGNCATEEEVWEFLGLLGIYDGILHSIYGDARKIITEDLVQDKYVVYRQVCNSDPPCYEFLWGPRAYAETTKMRVLRVLADSSNTSPGLYPHLYEDALIDEVERALRLRA

SEQ ID NO: 53090 - protein, 1142 aa, Homo sapiens
MGDKDMPTAGMPSLLQSSSESPQSCPEGEDSQSPLQIPQSSPESDDTLYPLQSPQSRSEGEDSSDPLQRPPEGKDSQSPLQIPQSSPEGDDTQSPLQNSQSSPEGKDSLSPLEISQSPPEGEDVQSPLQNPASSFFSSALLSIFQSSPESTQSPFEGFPQSVLQIPVSAASSSTLVSIFQSSPESTQSPFEGFPQSPLQIPVSRSFSSTLLSIFQSSPERTQSTFEGFAQSPLQIPVSPSSSSTLLSLFQSFSERTQSTFEGFAQSSLQIPVSPSFSSTLVSLFQSSPERTQSTFEGFPQSPLQIPVSSSSSSTLLSLFQSSPERTHSTFEGFPQSLLQIPMTSSFSSTLLSIFQSSPESAQSTFEGFPQSPLQIPGSPSFSSTLLSLFQSSPERTHSTFEGFPQSPLQIPMTSSFSSTLLSILQSSPESAQSAFEGFPQSPLQIPVSSSFSYTLLSLFQSSPERTHSTFEGFPQSPLQIPVSSSSSSSTLLSLFQSSPECTQSTFEGFPQSPLQIPQSPPEGENTHSPLQIVPSLPEWEDSLSPHYFPQSPPQGEDSLSPHYFPQSPPQGEDSLSPHYFPQSPQGEDSLSPHYFPQSPPQGEDSMSPLYFPQSPLQGEEFQSSLQSPVSICSSSTPSSLPQSFPESSQSPPEGPVQSPLHSPQSPPEGMHSQSPLQSPESAPEGEDSLSPLQIPQSPLEGEDSLSSLHFPQSPPEWEDSLSPLHFPQFPPQGEDFQSSLQSPVSICSSSTSLSLPQSFPESPQSPPEGPAQSPLQRPVSSFFSYTLASLLQSSHESPQSPPEGPAQSPLQSPVSSFPSSTSSSLSQSSPVSSFPSSTSSSLSKSSPESPLQSPVISFSSSTSLSPFSEESSSPVDEYTSSSDTLLESDSLTDSESLIESEPLFTYTLDEKVDELARFLLLKYQVKQPITKAEMLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 53091 - protein, 117 aa, Homo sapiens
GDKDMPTAGMPSLLQSSSESPQSCPEGEDSQSPLQIPVSPSSSSTLLSLFQSFSERTQSTFEGFAQSSLQIPVSPSFSSTLVSLFQSSPERTQSTFEGFPQSPLQIPVSSSSSSTLL

SEQ ID NO: 53092 - protein, 118 aa, Homo sapiens
MGDKDMPTAGMPSLLQSSSESPQSCPEGEDSQSPLQIPVSPSSSSTLLSLFQSFSERTQSTFEGFAQSSLQIPVSPSFSSTLVSLFQSSPERTQSTFEGFPQSPLQIPVSSSSSSTLL

SEQ ID NO: 53093 - protein, 209 aa, Homo sapiens
MLTNVISRYTGYFPVIFRKAREFIEILFGISLREVDPDDSYVFVNTLDLTSEGCLSDEQGMSQNRLLILILSIIFIKGTYASEEVIWDVLSGIGVRAGREHFAFGEPRELLTKVWVQEHYLEYREVPNSSPPRYEFLWGPRAHSEVIKRKVVEFLAMLKNTVPITFPSSYKDALKDVEERAQAIIDTTDDSTATESASSSVMSPSFSSE

SEQ ID NO: 53094 - protein, 373 aa, Homo sapiens
MPPVPGVPFRNVDNDSPTSVELEDWVDAQHPTDEEEEEASSASSTLYLVFSPSSFSTSSSLILGGPEEEEVPSGVIPNLTESIPSSPPQGPPQGPSQSPLSSCCSSFSWSSFSEESSSQKGEDTGTCQGLPDSESSFTYTLDEKVAELVEFLLLKYEAEEPVTEAEMLMIVIKYKDYFPVILKRAREFMELLFGLALIEVGPDHFCVFANTVGLTDEGSDDEGMPENSLLIIILSVIFIKGNCASEEVIWEVLNAVGVYAGREHFVYGEPRELLTKVWVQGHYLEYREVPHSSPPYYEFLWGPRAHSESIKKKVLEFLAKLNNTVPSSFPSWYKDALKDVEERVQATIDTADDATVMASESLSVMSSNVSFSE

SEQ ID NO: 53095 - protein, 643 aa, Homo sapiens
MLLPCHWVLDATFSDGSLGQWVKNTCATYALSPVVLPPQPQPRKKATDKDYSAFHLGHLREVRLFLRGGTSDQRMDSLVLCPTYFKLWRTLSGSPGLQLSDLHFGSQPEGKFSLRRAVSVKQREEPQDWPLNEKRTLWKDSDLPTWRRGTGYTLSLPAVSPGKRLWGEKAGSLPESEPLFTYTLDEKVDKLVQFLLLKYQAKEPLTRAEMQMNVINTYTGYFPMIFRKAREFIEILFGISLTEVDPDHFYVFVNTLDLTCEGSLSDEQGMPQNRLLILILSVIFIKGNCASEEVIWEVLNAIGPWSALAGFADVLSRLALWESEGPEAFCEESGLRSAEGSVLDLANPQGLAGHRQEDGRRGLTEASPQQKKGGEDEDMPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGPIQRPAREVLEFLSKLSSIIPSAFPSWYMDALKDMEDRAQAIIDTTDDATAMASASPSVMSTNFCPE

SEQ ID NO: 53096 - protein, 266 aa, Homo sapiens
MPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGVCAGREHFIYGDPRKLLTIHWVQRKYLEYREVPNSAPPRYEFLWGPRAHSEASKRSLRVFIQAIQYHP

SEQ ID NO: 53097 - protein, 126 aa, Homo sapiens
MDTGQLQLSRERSPGAGQQARRELCGRIAISQHGGKAQASPSHSLLSPLDKTDGEPWSALAGFADVLSRLALWESEGPEAFCEESGLRSAEGSVLDLANPQGKGPKGELRDFAPRTEEAPVCPALP

SEQ ID NO: 53098 - protein, 346 aa, Homo sapiens
MPLFPNLPRLSFEEDFQNPSVTEDLVDAQDSIDEEEEDASSTSSSSFHFLFPSSSSLSSSSPLSSPLPSTLILGVPEDEDMPAAGMPPLPQSPPEIPPQGPPKISPQGPPQSPPQSPLDSCSSPLLWTRLDEESSSEEEDTATWHALPESESLPRYALDEKVAELVQFLLLKYQTKEPVTKAEMLTTVIKKYKDYFPMIFGKAHEFIELIFGIALTDMDPDNHSYFFEDTLDLTYEGSLIDDQGMPKNCLLILILSMIFIKGSCVPEEVIWEVLSAIGVCAGREHFIYGDPRKLLTIHWVQRKYLEYREVPNSAPPRYEFLWGPRAHSEASKRSLRVFIQAIQYHP

SEQ ID NO: 53099 - protein, 346 aa, Homo sapiens; identical to SEQ ID NO: 53098

SEQ ID NO: 53100 - protein, 778 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 53101 - protein, 834 aa, Homo sapiens
MAQKMDCGAGLLGFQNPDACRAVCHPLPQPPASTLPLSAFPTLCDPPYSQLRDPPAVLSCYCTPLGASPAPAEASVEDSALLMQTLMEAIQISEAPPTNQATAAASPQSSQPPTANEMADIQVSAAAARPKSAFKVQNATTKGPNGVYDFSQAHNAKDVPNTQPKAAFKSQNATPKGPNAAYDFSQAATTGELAANKSEMAFKAQNATTKVGPNATYNFSQSLNANDLANSRPKTPFKAWNDTTKAPTADTQTQNVNQAKMATSQADIETDPGISEPDGATAQTSADGSQAQNLESRTIIRGKRTRKINNLNVEENSSGDQRRAPLAAGTWRSAPVPVTTQNPPGAPPNVLWQTPLAWQNPSGWQNQTARQTPPARQSPPARQTPPAWQNPVAWQNPVIWPNPVIWQNPVIWPNPIVWPGPVVWPNPLAWQNPPGWQTPPGWQTPPGWQGPPDWQGPPDWPLPPDWPLPPDWPLPTDWPLPPDWIPADWPIPPDWQNLRPSPNLRPSPNSRASQNPGAAQPRDVALLQERANKLVKYLMLKDYTKVPIKRSEMLRDIIREYTDVYPEIIERACFVLEKKFGIQLKEIDKEEHLYILISTPESLAGILGTTKDTPKLGLLLVILGVIFMNGNRASEAVLWEALRKMGLRPGVRHPLLGDLRKLLTYEFVKQKYLDYRRVPNSNPPEYEFLWGLRSYHETSKMKVLRFIAEVQKRDPRDWTAQFMEAADEALDALDAAAAEAEARAEARTRMGIGDEAVSGPWSWDDIEFELLTWDEEGDFGDPWSRIPFTFWARYHQNARSRFPQTFAGPIIGPGGTASANFAANFGAIGFFWVE

SEQ ID NO: 53102 - protein, 778 aa, Homo sapiens; identical to SEQ ID NO: 53100

SEQ ID NO: 53103 - protein, 778 aa, Homo sapiens; identical to SEQ ID NO: 53100

SEQ ID NO: 53104 - protein, 137 aa, Homo sapiens
MAQKMDCGAGLLGFQAEASVEDSALLMQTLMEAIQISEAPPTNQATAAASPQSSQPPTANEMADIQVSAAAARPKSAFKVQNATTKGPNGVYDFSQSLNANDLANSRPKTQVSLNLTVQLHRHQQMVPRLRIWSPGQ

SEQ ID NO: 53105 - protein, 606 aa, Homo sapiens
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 53106 - protein, 588 aa, Homo sapiens
MSDTSESGAGLTRFQAEASEKDSSSMMQTLLTVTQNVEVPETPKASKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 53107 - protein, 550 aa, Homo sapiens
MWRSQRHRRPQRVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 53108 - protein, 606 aa, Homo sapiens; identical to SEQ ID NO: 53105

SEQ ID NO: 53109 - protein, 606 aa, Homo sapiens; identical to SEQ ID NO: 53105

SEQ ID NO: 53110 - protein, 521 aa, Homo sapiens
MSDTSESGAGLTRFQAEASEKDSSSMMQTLLTVTQNVEVPETPKASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKARRRAAKLQSSQEPEAPPPRDVALLQGRANDLVKYLLAKDQTKIPIKRSDMLKDIIKEYTDVYPEIIERAGYSLEKVFGIQLKEIDKNDHLYILLSTLEPTDAGILGTTKDSPKLGLLMVLLSIIFMNGNRSSEAVIWEVLRKLGLRPGIHHSLFGDVKKLITDEFVKQKYLDYARVPNSNPPEYEFFWGLRSYYETSKMKVLKFACKVQKKDPKEWAAQYREAMEADLKAAAEAAAEAKARAEIRARMGIGLGSENAAGPCNWDEADIGPWAKARIQAGAEAKAKAQESGSASTGASTSTNNSASASASTSGGFSAGASLTATLTFGLFAGLGGAGASTSGSSGACGFSYK

SEQ ID NO: 53111 - protein, 521 aa, Homo sapiens; identical to SEQ ID NO: 53110

SEQ ID NO: 53112 - protein, 606 aa, Homo sapiens; identical to SEQ ID NO: 53105

SEQ ID NO: 53113 - protein, 606 aa, Homo sapiens; identical to SEQ ID NO: 53105

SEQ ID NO: 53114 - protein, 739 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQ

SEQ ID NO: 53115 - protein, 757 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKNPELREETPLSMAPSWYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 53116 - protein, 741 aa, Homo sapiens
MAEGSFSVQSESYSVEDMDEGSDEVGEEEMVEGNDYEEFGAFGGYGTLTSFDIHILRAFGSLGPGLRILSNEPWELENPVLAQTLVEALQLDPETLANETAARAANVARAAASNRAARAAAAAARTAFSQVVASHRVATPQVSGEDTQPTTYAAEAQGPTPEPPLASPQTSQMLVTSKMAAPEAPATSAQSQTGSPAQEAATEGPSSACAFSQAPCAREVDANRPSTAFLGQNDVFDFTQPAGVSGMAFPRPKRPAPAQEAATEGPSAASGVPQTGPGREVAATRPKTTKSGKALAKTRWVEPQNVVAAAAAKAKMATSIPEPEGAAAATAQHSAEPWARMGGKRTKKSKHLDDEYESSEEERETPAVPPTWRASQPSLTVRAQLAPRPPMAPRSQIPSRHVLCLPPRNVTLLQERANKLVKYLMIKDYKKIPIKRADMLKDVIREYDEHFPEIIERATYTLEKKFGIHLKEIDKEEHLYILVCTRDSSARLLGKTKDTPRLSLLLVILGVIFMNGNRASEAVLWEALRKMGLRPGVRHPFLGDLRKLITDDFVKQKYLEYKKIPNSNPPEYEFLWGLRARHETSKMRVLRFIAQNQNRDPREWKAHFLEAVDDAFKTMDVDMAEEHARAQMRAQMNIGDEALIGRWSWDDIQVELLTWDEDGDFGDAWARIPFAFWARYHQYILNSNRANRRATWRAGVSSGTNGGASTSVLDGPSTSSTIRTRNAARAGASFFSWIQHR

SEQ ID NO: 53117 - protein, 739 aa, Homo sapiens; identical to SEQ ID NO: 53114

SEQ ID NO: 53118 - protein, 757 aa, Homo sapiens; identical to SEQ ID NO: 53115

SEQ ID NO: 53119 - protein, 741 aa, Homo sapiens; identical to SEQ ID NO: 53116

SEQ ID NO: 53120 - protein, 957 aa, Homo sapiens
MSLVSQNSRRRRRRVAKATAHNSSWGEMQAPNAPGLPADVPGSDVPQGPSDSQILQGLCASEGPSTSVLPTSAEGPSTFVPPTISEASSASGQPTISEGPGTSVLPTPSEGLSTSGPPTISKGLCTSVTLAASEGRNTSRPPTSSEEPSTSVPPTASEVPSTSLPPTPGEGTSTSVPPTAYEGPSTSVVPTPDEGPSTSVLPTPGEGPGTSVPLAATEGLSTSVQATPDEGPSTSVPPTATEGLSTPVPPTRDEGPSTSVPATPGEGPSTSVLPAASDGQSISLVPTRGKGSSTSVPPTATEGLSTSVQPTAGEGSSTSVPPTPGGGLSTSVPPTATEELSTSVPPTPGEGPSTSVLPIPGEGLSTSVPPTASDGSDTSVPPTPGEGASTLVQPTAPDGPGSSVLPNPGEGPSTLFSSSASVDRNPSKCSLVLPSPRVTKASVDSDSEGPKGAEGPIEFEVLRDCESPNSISIMGLNTSRVAITLKPQDPMEQNVAELLQFLLVKDQSKYPIRESEMREYIVKEYRNQFPEILRRAAAHLECIFRFELRELDPEAHTYILLNKLGPVPFEGLEESPNGPKMGLLMMILGQIFLNGNQAKEAEIWEMLWRMGVQRERRLSIFGNPKRLLSVEFVWQRYLDYRPVTDCKPVEYEFFWGPRSHLETTKMKILKFMAKIYNKDPMDWPEKYNEALEEDAARAFAEGWQALPHFRRPFFEEAAAEVPSPDSEVSSYSSKYAPHSWPESRLESKARKLVQLFLLMDSTKLPIPKKGILYYIGRECSKVFPDLLNRAARTLNHVYGTELVVLDPRNHSYTLYNRREMEETEEIVDSPNRPGNNFLMQVLSFIFIMGNHARESAVWAFLRGLGVQAGRKHVITCRYLSQRYIDSLRVPDSDPVQYEFVWGPRARLETSKMKALRYVARIHRKEPQDWPQQYREAMEDEANRADVGHRQIFVHNFR

SEQ ID NO: 53121 - protein, 523 aa, Homo sapiens
MSLVSQNARHCSAEITADYGDGRGEIQATNASGSPTSMLVVDAPQCPQAPINSQCVNTSQAVQDPNDLEVLIDEQSRRLGALRVHDPLEDRSIALVNFMRMKSQTEGSIQQSEMLEFLREYSDQFPEILRRASAHLDQVFGLNLRVIDPQADTYNLVSKRGFQITDRIAESLDMPKASLLALVLGHILLNGNRAREASIWDLLLKVDMWDKPQRINNLFGNTRNLLTTDFVCMRFLEYWPVYGTNPLEFEFLWGSRAHREITKMEALKFVSDAHDEEPWSWPEEYNKALEGDKTKERSLTAGLEFWSEDTMNDKANDLVQLAISVTEEMLPIHQDELLAHTGKEFEDVFPNILNRATLILDMFYGLSLIEVDTSEHIYLLVQQPESEEEQVMLESLGRPTQEYVMPILGLIFLMGNRVKEANVWNLLRRFSVDVGRKHSITRKLMRQRYLECRPLSYSNPVEYELLWGPRAHHETIKMKVLEYMARLYRKRPQNWPEQYREAVEDEEARAKSEATIMFFLDPT

SEQ ID NO: 53122 - protein, 307 aa, Homo sapiens
MLQTPESRGLPVPQAEGEKDGGHDGETRAPTASQERPKEELGAGREEGAAEPALTRKGARALAAKALARRRAYRRLNRTVAELVQFLLVKDKKKSPITRSEMVKYVIGDLKILFPDIIARAAEHLRYVFGFELKQFDRKHHTYILINKLKPLEEEEEEDLGGDGPRLGLLMMILGLIYMRGNSAREAQVWEMLRRLGVQPSKYHFLFGYPKRLIMEDFVQQRYLSYRRVPHTNPPEYEFSWGPRSNLEISKMEVLGFVAKLHKKEPQHWPVQYREALADEADRARAKARAEASMRARASARAGIHLW

SEQ ID NO: 53123 - protein, 131 aa, Homo sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDKWDFYCQ

SEQ ID NO: 53124 - protein, 213 aa, Homo sapiens
MAETYDFLFKFLVIGSAGTGKSCLLHQFIENKFKQDSNHTIGVEFGSRVVNVGGKTVKLQIWDTAGQERFRSVTRSYYRGAAGALLVYDITSRETYNSLAAWLTDARTLASPNIVVILCGNKKDLDPEREVTFLEASRFAQENELMFLETSALTGENVEEAFLKCARTILNKIDSGELDPERMGSGIQYGDASLRQLRQPRSAQAVAPQPCGC

SEQ ID NO: 53125 - protein, 121 aa, Homo sapiens
MAETYDFLFKFLVIGSAGTGKSCLLHQFIENKFKQDSNHTIGVEFGSRVVNVGGKTVKLQIWDTAGQERFRSVTRSYYRGAAGALLVYDITRADVPGDQRSHRRERGGGVPQVCPHYPQQD

SEQ ID NO: 53126 - protein, 131 aa, Homo sapiens
MARSLVCLGVIILLSAFSGPGVRGGPMPKLADRKLCADQECSHPISMAVALQDYMAPDCRFLTIHRGQVVYVFSKLKGRGRLFWGGSVQGDYYGDLAARLGYFPSSIVREDQTLKPGKVDVKTDTSSSNSW

SEQ ID NO: 53127 - protein, 785 aa, Homo sapiens
MDSVPATVPSIAATPGDPELVGPLSVLYAAFIAKLLELVATLPDDVQPGPDFYGLPWKPVFITAFLGIASFAIFLWRTVLVVTDTLVSVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 53128 - protein, 1848 aa, Homo sapiens
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVSNTVYYVTEQQISEKLKTIMKENTELVQKLSNYEQKIKESKKHVQETRKQNMILSDEAIKYKDKIKTLEKNQEILDDTAKNLRVMLESEREQNVKNQDLLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 53129 - protein, 785 aa, Homo sapiens
MDSVPATVPSIAATPGDPELVGPLSVLYAAFIAKLLELVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 53130 - protein, 1907 aa, Homo sapiens
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVSNTVYYVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 53131 - protein, 500 aa, Homo sapiens
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGFKTEPIKL

SEQ ID NO: 53132 - protein, 1907 aa, Homo sapiens
MAAAPGLLVWLLVLRLPWRVPGQLDPSTGRRFSEHKLCADDECSMLMYRGEALEDFTGPDCRFVNFKKGDPVYVYYKLARGWPEVWAGSVGRTFGYFPKDLIQVVHEYTKEELQVPTDETDFVCFDGGRDDFHNYNVEELLGFLELYNSAATDSEKAVEKTLQDMEKNPELSKEREPEPEPVEANSEESDSVFSENTEDLQEQFTTQKHHSHANSQANHAQGEQASFESFEEMLQDKLKVPESENNKTSNSSQVSNEQDKIDAYKLLKKEMTLDLKTKFGSTADALVSDDETTRLVTSLEDDFDEELDTEYYAVGKEDEENQEDFDELPLLTFTDGEDMKTPAKSGVEKYPTDKEQNSNEEDKVQLTVPPGIKNDDKNILTTWGDTIFSIVTGGEETRDTMDLESSSSEEEKEDDDDALVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLISENKKSIEKLKDVISMNASEFSEVQIALNEAKLSEEKVKSECHRVQEENARLKKKKEQLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQVKKLEDDRNSLQAAKAGLEDECKTLRQKVEILNELYQQKEMALQKKLSQEEYERQEREHRLSAADEKAVSAAEEVKTYKRRIEEMEDELQKTERSFKNQIATHEKKAHENWLKARAAERAIAEEKREAANLRHKLLELTQKMAMLQEEPVIVKPMPGKPNTQNPPRRGPLSQNGSFGPSPVSGGECSPPLTVEPPVRPLSATLNRRDMPRSEFGSVDGPLPHPRWSAEASGKPSPSDPGSGTATMMNSSSRGSSPTRVLDEGKVNMAPKGPPPFPGVPLMSTPMGGPVPPPIRYGPPPQLCGPFGPRPLPPPFGPGMRPPLGLREFAPGVPPGRRDLPLHPRGFLPGHAPFRPLGSLGPREYFIPGTRLPPPTHGPQEYPPPPAVRDLLPSGSRDEPPPASQSTSQDCSQALKQSP

SEQ ID NO: 53133 - protein, 1016 aa, Homo sapiens
  MOD_RES (1)..(1): Any amino acid
XLVPDSKQGKPQSATDYSDPDNVDDGLFIVDIPKTNNDKEVNAEHHIKGKGRGVQESKRGLVQDKTELEDENQEGMTVHSSVHSNNLNSMPAAEKGKDTLKSAYDDTENDLKGAAIHISKGMLHEEKPGEQILEGGSESESAQKAAGNQMNDRKIQQESLGSAPLMGDDHPNASRDSVEGDALVNGAKLHTLSVEHQREELKEELVLKTQNQPRFSSPDEIDLPRELEDEVPILGRNLPWQQERDVAATASKQMSEKIRLSEGEAKEDSLDEEFFHHKAMQGTEVGQTDQTDSTGGPAFLSKVEEDDYPSEELLEDENAINAKRSKEKNPGNQGRQFDVNLQVPDRAVLGTIHPDPEIEESKQETSMILDSEKTSETAAKGVNTGGREPNTMVEKERPLADKKAQRPFERSDFSDSIKIQTPELGEVFQNKDSDYLKNDNPEEHLKTSGLAGEPEGELSKEDHENTEKYMGTESQGSAAAEPEDDSFHWTPHTSVEPGHSDKREDLLIISSFFKEQQSLQRFQKYFNVHELEALLQEMSSKLKSAQQESLPYNMEKVLDKVFRASESQILSIAEKMLDTRVAENRDLGMNENNIFEEAAVLDDIQDLIYFVRYKHSTAEETATLVMAPPLEEGLGGAMEEMQPLHEDNFSREKTAELNVQVPEEPTHLDQRVIGDTHASEVSQKPNTEKDLDPGPVTTEDTPMDAIDANKQPETAAEEPASVTPLENAILLIYSFMFYLTKSLVATLPDDVQPGPDFYGLPWKPVFITAFLGIASFAIFLWRTVLVVKDRVYQVTEQQISEKLKTIMKENTELVQKLSNYEQKIKESKKHVQETRKQNMILSDEAIKYKDKIKTLEKNQEILDDTAKNLRVMLESEREQNVKNQDLLQQEIEDWSKLHAELSEQIKSFEKSQKDLEVALTHKDDNINALTNCITQLNLLECESESEGQNKGGNDSDELANGEVGGDRNEKMKNQIKQMMDVSRTQTAISVVEEDLKLLQLKLRASVSTKCNLEDQV

SEQ ID NO: 53134 - protein, 107 aa, Homo sapiens
  MOD_RES (1)..(1): Any amino acid
XSAEASGKPSPSDPGSGTATMMNSSSRGSSPTRVLDEGKVNMAPKGPPPFPGVPLMSTPMGGPVPPPIRYGPPPQLCGPFGPRPLPPPFDKDGRPGTVAHACNPSTL

SEQ ID NO: 53135 - protein, 600 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 53136 - protein, 572 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPIFLPRVAGKLGKRPEDPNADPSSEAKAMAVPYLLRRKFSNSLKSQGKDDDSFDRKSVYRGSLTQRNPNARKGMASHTFAKPVVAHQS

SEQ ID NO: 53137 - protein, 131 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKR

SEQ ID NO: 53138 - protein, 70 aa, Homo sapiens
MGKKLDLSKLTDEEAQHVLEVVQRDFDLRRKEEERLEALKGKIKKESSKRELLSDTAHLNETHCARCLQP

SEQ ID NO: 53139 - protein, 551 aa, Homo sapiens
MGKKLDLSKLTDEEAQHVLEVVQRDFDLRRKEEERLEALKGKIKKESSKRELLSDTAHLNETHCARCLQPYQLLVNSKRQCLECGLFTCKSCGRVHPEEQGWICDPCHLARVVKIGSLEWYYEHVKARFKRFGSAKVIRSLHGRLQGGAGPELISEERSGDSDQTDEDGEPGSEAQAQAQPFGSKKKRLLSVHDFDFEGDSDDSTQPQGHSLHLSSVPEARDSPQSLTDESCSEKAAPHKAEGLEEADTGASGCHSHPEEQPTSISPSRHGALAELCPPGGSHRMALGTAAALGSNVIRNEQLPLQYLADVDTSDEESIRAHVMASHHSKRRGRASSESQIFELNKHISAVECLLTYLENTVVPPLAKGLGAGVRTEADVEEEALRRKLEELTSNVSDQETSSEEEEAKDEKAEPNRDKSVGPLPQADPEVGTAAHQTNRQEKSPQDPGDPVQYNRTTDEELSELEDRVAVTASEVQQAESEVSDIESRIAALRAAGLTVKPSGKPRRKSNLPALYEGTLSLCSEDLKHTHPDSVKSKRSRLNHVASCGNP

SEQ ID NO: 53140 - protein, 224 aa, Homo sapiens
MGLRDWLRTVCCCCGCECLEERALPEKEPLVSDNNPYSSFGATLVRDDEKNLWSMPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFVVDRLIALDAAEEFFKLARRTYPKKPGVPCLADGQKELHLWGDLSCRLAHMQGVLH

SEQ ID NO: 53141 - protein, 214 aa, Homo sapiens
MGLRDWLRTVCCCCGCECLEERALPEKEPLVSDNNPYSSFGATLVRDDEKNLWSMPHDVSHTEADDDRTLYNLIVIRNQQAKDSEEWQKLNYDIHTLRQVRREVRNRWKCILEDLGFQKEADSLLSVTKLSTISDSKNTRKAREMLLKLAEETNIFPTSWELSERYLFVVDRLIALDAAEEFFKLARRTYPKKPGVPCLADGQKELHYLPFPSP

SEQ ID NO: 53142 - protein, 214 aa, Homo sapiens; identical to SEQ ID NO: 53141

SEQ ID NO: 53143 - protein, 350 aa, Homo sapiens [sequence omitted]

SEQ ID NO: 53144 - protein, 362 aa, Homo sapiens
MSENGSFANCCEAGGWAVRPGWSGAGSARPSRTPRPPWVAPALSAVLIVTTAVDVVGNLLVILSVLRNRKLRNAGNLFLVSLALADLVVAFYPYPLILVAIFYDGWALGEEHCKASAFVMGLSVIGSVFNITAIAINRYCYICHSMAYHRIYRRWHTPLHICLIWLLTVVALLPNFFVGSLEYDPRIYSCTFIQTASTQYTAAVVVIHFLLPIAVVSFCYLRIWVLVLQARRKAKPESRLCLKPSDLRSFLTMFVVFVIFAICWAPLNCIGLAVAINPQEMAPQIPEGLFVTSYLLAYFNSCLNAIVYGLLNQNFRREYKRILLALWNPRHCIQDASKGSHAEGLQSPAPPIIGVQHQADAL

SEQ ID NO: 53145 - protein, 1287 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHNQTTTPAATATAPPPVHKVFRK

SEQ ID NO: 53146 - protein, 1462 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRLPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYDPSSDRHGPATGPQGVPEVRAGPDRRQHPSLESSYPPDLHKSSPHGEKRAHARDPKGSREYSRQPNEHHTWNGTSRKPDSGACRPKDRAPEGRRDAQAERAAAANGPKRRSPEKRREGTRSADNTLERREKHEKRRDVSPERRRERSPTRRRDGSPSRRRRSLERLLEQRRSPERRRGGSPERRAKSTDRRRARSPERRRERSLDKRNREDRASHREREEANLKQDAGRSSRHPPEQRRRPYKECSTDLSI

SEQ ID NO: 53147 - protein, 1183 aa, Homo sapiens
GGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYAMIPPNIAACMRNEKLGEACFYLMGHNQTTTPAATATAPPPVHKVFRK

SEQ ID NO: 53148 - protein, 1256 aa, Homo sapiens
MSKVIQKKNHWTSRVHECTVKRGPQGELGVTVLGGAEHGEFPYVGAVAAVEAAGLPGGGEGPRLGEGELLLEVQGVRVSGLPRYDVLGVIDSCKEAVTFKAVRQGGRLNKDLRHFLNQRFQKGSPDHELQQTIRDNLYRHAVPCTTRSPREGEVPGVDYNFLTVKEFLDLEQSGTLLEVGTYEGNYYGTPKPPSQPVSGKVITTDALHSLQSGSKQSTPKRTKSYNDMQNAGIVHAENEEEDDVPEMNSSFTADSGEQEEHTLQETALPPVNSSIIAAPITDPSQKFPQYLPLSAEDNLGPLPENWEMAYTENGEVYFIDHNTKTTSWLDPRCLNKQQKPLEECEDDEGVHTEELDSELELPAGWEKIEDPVYGIYYVDHINRKTQYENPVLEAKRKKQLEQQQQQQQQQQQQQQQQQQQQTEEWTEDHSALVPPVIPNHPPSNPEPAREVPLQGKPFFTRNPSELKGKFIHTKLRKSSRGFGFTVVGGDEPDEFLQIKSLVLDGPAALDGKMETGDVIVSVNDTCVLGHTHAQVVKIFQSIPIGASVDLELCRGYPLPFDPDDPNTSLVTSVAILDKEPIIVNGQETYDSPASHSSKTGKVNGMKDARPSSPADVASNSSHGYPNDTVSLASSIATQPELITVHIVKGPMGFGFTIADSPGGGGQRVKQIVDSPRCRGLKEGDLIVEVNKKNVQALTHNQVVDMLVECPKGSEVTLLVQRGGLPVPKKSPKSQPLERKDSQNSSQHSVSSHRSLHTASPSHSTQVLPEFPPAEAQAPDQTDSSGQKKPDPFKIWAQSRSMYENRPMSPSPASGLSKGEREREINSTNFGECPIPDYQEQDIFLWRKETGFGFRILGGNEPGEPIYIGHIVPLGAADTDGRLRSGDELICVDGTPVIGKSHQLVVQLMQQAAKQGHVNLTVRRKVVFAVPKTENEVPSPASSHHSSNQPASLTEEKRTPQGSQNSLNTVSSGSGSTSGIGSGGGGGSGVVSTVVQPYDVEIRRGENEGFGFVIVSSVSRPEAGTTFAGNACVAMPHKIGRIIEGSPADRCGKLKVGDRILAVNGCSITNKSHSDIVNLIKEAGNTVTLRIIPGDESSNATLLTNAEKIATITTTHTPSQQGTQETRNTTKPKQESQFEFKAPQATQEQDFYTVELERGAKGFGFSLRGGREYNMDLYVLRLAEDGPAERCGKMRIGDEILEINGETTKNMKHSRAIELIKNGGRRVRLFLKRGDGSVPEYGGSNYENIPSFPGMTP

SEQ ID NO: 53149 - protein, 495 aa, Homo sapiens
MAAEPQPSSLSYRTTGSTYLHPLSELLGIPLDQVNFVVCQLVALFAAFWFRIYLRPGTTSSDVRHAVATIFGIYFVIFCFGWYSVHLFVLVLMCYAIMVTASVSNIHRYSFFVAMGYLTICHISRIYIFHYGILTTDFSGPLMIVTQKITTLAFQVHDGLGRRAEDLSAEQHRLAIKVKPSFLEYLSYLLNFMSVIAGPCNNFKDYIAFIEGKHIHMKLLEVNWKRKGFHSLPEPSPTGAVIHKLGITLVSLLLFLTLTKTFPVTCLVDDWFVHKASFPARLCYLYVVMQASKPKYYFAWTLADAVNNAAGFGFSGVDKNGNFCWDLLSNLNIWKIETATSFKMYLENWNIQTATWLKCVCYQRVPWYPTVLTFILSALWHGVYPGYYFTFLTGILVTLAARAVRNNYRHYFLSSRALKAVYDAGTWAVTQLAVSYTVAPFVMLAVEPTISLYKSMYFYLHIISLLIILFLPMKPQAHTQRRPQTLNSINKRKTD

SEQ ID NO: 53150 - protein, 241 aa, Homo sapiens
MAAEPQPSSLSYRTTGSTYLHPLSELLGIPLDQVNFVVCQLVALFAAFWFRIYLRPGTTSSDVRHAVATIFGIYFVIFCFGWYSVHLFVLVLMCYAIMVTASVSNIHRYSFFVAMGYLTICHISRIYIFHYGILTTDFSGPLMIVTQKITTLAFQVHDGLGRRAEDLSAEQHRLAIKVKPSFLEYLSYLLNFMSVIAGPCNNFKDYIAFIEGKHIHMKLLEVNWKRKGFHSLPEPSPTGHL

SEQ ID NO: 53151 - protein, 346 aa, Homo sapiens
MEFSLRIFLGLGRRAEDLSAEQHRLAIKVKPSFLEYLSYLLNFMSVIAGPCNNFKDYIAFIEGKHIHMKLLEVNWKRKGFHSLPEPSPTGAVIHKLGITLVSLLLFLTLTKTFPVTCLVDDWFVHKASFPARLCYLYVVMQASKPKYYFAWTLADAVNNAAGFGFSGVDKNGNFCWDLLSNLNIWKIETATSFKMYLENWNIQTATWLKCVCYQRVPWYPTVLTFILSALWHGVYPGYYFTFLTGILVTLAARAVRNNYRHYFLSSRALKAVYDAGTWAVTQLAVSYTVAPFVMLAVEPTISLYKSMYFYLHIISLLIILFLPMKPQAHTQRRPQTLNSINKRKTD

SEQ ID NO: 53152 - protein, 520 aa, Homo sapiens
MATTSTTGSTLLQPLSNAVQLPIDQVNFVVCQLFALLAAIWFRTYLHSSKTSSFIRHVVATLLGLYLALFCFGWYALHFLVQSGISYCIMIIIGVENMHNYCFVFALGYLTVCQVTRVYIFDYGQYSADFSGPMMIITQKITSLACEIHDGMFRKDEELTSSQRDLAVRRMPSLLEYLSYNCNFMGILAGPLCSYKDYITFIEGRSYHITQSGENGKEETQYERTEPSPNTAVVQKLLVCGLSLLFHLTICTTLPVEYNIDEHFQATASWPTKIIYLYISLLAARPKYYFAWTLADAINNAAGFGFRGYDENGAARWDLISNLRIQQIEMSTSFKMFLDNWNIQTALWLKRVCYERTSFSPTIQTFILSAIWHGVYPGYYLTFLTGVLMTLAARAMRNNFRHYFIEPSQLKLFYDVITWIVTQVAISYTVVPFVLLSIKPSLTFYSSWYYCLHILGILVLLLLPVKKTQRRKNTHENIQLSQSKKFDEGENSLGQNSFSTTNNVCNQNQEIASRHSSLKQ

SEQ ID NO: 53153 - protein, 435 aa, Homo sapiens
MEWLWLFFLHPISFYQGAAFPFALLFNYLCIMDSFSTRARYLFLLTGGGALAVAAMGSYAVLVFTPAVCAVALLCSLAPQQVHRWTFCFQMSWQTLCHLGLHYTEYYLHEPPSVRFCITLSSLMLLTQRVTSLSLDICEGKVKAASGGFRSRSSLSEHVCKALPYFSYLLFFPALLGGSLCSFQRFQARVQGSSALHPRHSFWALSWRGLQILGLECLNVAVSRVVDAGAGLTDCQQFECIYVVWTTAGLFKLTYYSHWILDDSLLHAAGFGPELGQSPGEEGYVPDADIWTLERTHRISVFSRKWNQSTARWLRRLVFQHSRAWPLLQTFAFSAWWHGLHPGQVFGFVCWAVMVEADYLIHSFANEFIRSWPMRLFYRTLTWAHTQLIIAYIMLAVEVRSLSSLWLLCNSYNSVFPMVYCILLLLLAKRKHKCN

SEQ ID NO: 53154 - protein, 446 aa, Homo sapiens
MTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 53155 - protein, 466 aa, Homo sapiens
MTLKASEGESGGSMHTALSDLYLEHLLQKRSRPEAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 53156 - protein, 436 aa, Homo sapiens
MESWAVSHPLNTVTEDMYTNGSPAPGSPAQVKGQEVRKVRLIQFEKVTEEPMGITLKLNEKQSCTVARILHGGMIHRQGSLHVGDEILEINGTNVTNHSVDQLQKAMKETKGMISLKVIPNQQSRLPALQMFMRAQFDYDPKKDNLIPCKEAGLKFATGDIIQIINKDDSNWWQGRVEGSSKESAGLIPSPELQEWRVASMAQSAPSEAPSCSPFGKKKKYKDKYLAKHSSIFDQLDVVSYEEVVRLPAFKRKTLVLIGASGVGRSHIKNALLSQNPEKFVYPVPYTTRPPRKSEEDGKEYHFISTEEMTRNISANEFLEFGSYQGNMFGTKFETVHQIHKQNKIAILDIEPQTLKIVRTAELSPFIVFIAPTDQGTQTEALQQLQKDSEAIRSQYAHYFDLSLVNNGVDETLKKLQEAFDQACSSPQWVPVSWVY

SEQ ID NO: 53157 - protein, 552 aa, Homo sapiens
MPVAATNSETAMQQVLDNLGSLPSATGAAELDLIFLRGIMESPIVRSLAKAHERLEETKLEAVRDNNLELVQEILRDLAHVAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 53158 - protein, 576 aa, Homo sapiens
MPVAATNSETAMQQVLDNLGSLPSATGAAELDLIFLRGIMESPIVRSLAKVIMVLWFMQQNVFVPMKYMLKYFGAHERLEETKLEAVRDNNLELVQEILRDLAHVAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 53159 - protein, 31 aa, Homo sapiens
MPVAATNSETAMQQVLDNLGSLPSATGAAEL

SEQ ID NO: 53160 - protein, 151 aa, Homo sapiens
MPVAATNSETAMQQVLDNLGSLPSATGAAELDLIFLRGIMESPIVRSLAKAHERLEETKLEAVRDNNLELVQEILRDLAHVAEQSSTAAELAHILQEPHFQSLLETHDSVASKTYETPPPSPGLDPTFSNQPVPPDAVRMVGIRKTAGEHL

SEQ ID NO: 53161 - protein, 126 aa, Homo sapiens
MPVAATNSETAMQQVLDNLGSLPSATGAAELDLIFLRGIMESPIVRSLAKAHERLEETKLEAVRDNNLELVQEILRDLAHVAEQSSTAAELAHILQEPHFQSLLETHDSVASKTYETPPPSPGLDP

SEQ ID NO: 53162 - protein, 73 aa, Homo sapiens
MPVAATNSETAMQQVLDNLGSLPSATGAAELDLIFLRGIMESPIVRSLAKAHERLEETKLEAVRDNNLELVQE

SEQ ID NO: 53163 - protein, 148 aa, Homo sapiens
MPVAATNSETAMQQVLDNLGSLPSATGAAELDLIFLRGIMESPIVRSLAKAHERLEETKLEAVRDNNLELVQEILRDLAHVAEQSSTAAELAHILQEPHFQSLLETHDSVASKTYETPPPSPGLDPTFSNQPVPPDAVRMVGIRKTAG

SEQ ID NO: 53164 - protein, 541 aa, Homo sapiens
MQQVLDNLGSLPSATGAAELDLIFLRGIMESPIVRSLAKAHERLEETKLEAVRDNNLELVQEILRDLAHVAEQSSTAAELAHILQEPHFQSLLETHDSVASKTYETPPPSPGLDPTFSNQPVPPDAVRMVGIRKTAGEHLGVTFRVEGGELVIARILHGGMVAQQGLLHVGDIIKEVNGQPVGSDPRALQELLRNASGSVILKILPSYQEPHLPRQVFVKCHFDYDPARDSLIPCKEAGLRFNAGDLLQIVNQDDANWWQACHVEGGSAGLIPSQLLEEKRKAFVKRDLELTPNSGTLCGSLSGKKKKRMMYLTTKNAEFDRHELLIYEEVARMPPFRRKTLVLIGAQGVGRRSLKNKLIMWDPDRYGTTVPYTSRRPKDSEREGQGYSFVSRGEMEADVRAGRYLEHGEYEGNLYGTRIDSIRGVVAAGKVCVLDVNPQAVKVLRTAEFVPYVVFIEAPDFETLRAMNRAALESGISTKQLTEADLRRTVEESSRIQRGYGHYFDLCLVNSNLERTFRELQTAMEKLRTEPQWVPVSWVY

SEQ ID NO: 53165 - protein, 388 aa, Homo sapiens
MELQYPPPPPSPRICRERSGGDNASMPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAYGTPISPQFSQPKQELSLPRHWAPTQLLPSCGAHCPGGKGTHTPTLIPILLSPSLQLEFIQY

SEQ ID NO: 53166 - protein, 585 aa, Homo sapiens
MPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 53167 - protein, 610 aa, Homo sapiens
MELQYPPPPPSPRICRERSGGDNASMPVLSEDSGLHETLALLTSQLRPDSNHKEEMGFLRDVFSEKSLSYLMKIHEKLRYYERQSPTPVLHSAVALAEDVMEELQAASVHSDERELLQLLSTPHLRAVLMVHDTVAQKNFDPVLPPLPDNIDEDFDEESVKIVRLVKNKEPLGATIRRDEHSGAVVVARIMRGGAADRSGLVHVGDELREVNGIAVLHKRPDEISQILAQSQGSITLKIIPATQEEDRLKESKVFMRALFHYNPREDRAIPCQEAGLPFQRRQVLEVVSQDDPTWWQAKRVGDTNLRAGLIPSKGFQERRLSYRRAAGTLPSPQSLRKPPYDQPCDKETCDCEGYLKGHYVAGLRRSFRLGCRERLGGSQEGKMSSGAESPELLTYEEVARYQHQPGERPRLVVLIGSLGARLHELKQKVVAENPQHFGVAVPHTTRPRKSHEKEGVEYHFVSKQAFEADLHHNKFLEHGEYKENLYGTSLEAIQAVMAKNKVCLVDVEPEALKQLRTSEFKPYIIFVKPAIQEKRKTPPMSPACEDTAAPFDEQQQEMAASAAFIDRHYGHLVDAVLVKEDLQGAYSQLKVVLEKLSKDTHWVPVSWVR

SEQ ID NO: 53168 - protein, 593 aa, Homo sapiens
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMDPDIPCMDAGLPFQKGDILQIVDQNDALWWQARKISDPATCAGLVPSNHLLKRKQREFWWSQPYQPHTCLKSTLYKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 53169 - protein, 602 aa, Homo sapiens
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRWSFALVAQAGVQWHYLDSLQPLPPGFKRFSCLSLPRSWDYIEDDMKIDEKCVEAEKESIETDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 53170 - protein, 637 aa, Homo sapiens
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLSISLKGEDDMKIDEKCVEAENSTAESEELNSDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 53171 - protein, 566 aa, Homo sapiens
MIQSDKGADPPDKKDMKLSTATNPQNGLSQILRLVLQELSLFYGRDVNGVCLLYDLLHSPWLQALLKIYDCLQEFKEKKLVPATPHAQVLSYEGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLSISLKGEDDMKIDEKCVEAENSTAESEELNSDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 53172 - protein, 637 aa, Homo sapiens
MIQSDKGADPPDKKDMKLSTATNPQNGLSQILRLVLQELSLFYGRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWPQEDPDIPCMDAGLPFQKGDILQIVDQNDALWWQARKISDPATCAGLVPSNHLLKRKQREFWWSQPYQPHTCLKSTLSISMEEEDDMKIDEKCVEADEETFESEELSEDKEEFVGYGQKFFIAGFRRSMRLCRRKSHLSPLHASVCCTGSCYSAVGAPYEEVVRYQRRPSDKYRLIVLMGPSGVGVNELRRQLIEFNPSHFQSAVPHTTRTKKSYEMNGREYHYVSKETFENLIYSHRMLEYGEYKGHLYGTSVDAVQTVLVEGKICVMDLEPQDIQGVRTHELKPYVIFIKPSNMRCMKQSRKNAKVITDYYVDMKFKDEDLQEMENLAQRMETQFGQFFDHVIVNDSLHDACAQLLSAIQKAQEEPQWVPATWISSDTESQ

SEQ ID NO: 53173 - protein, 675 aa, Homo sapiens
MTTSHMNGHVTEESDSEVKNVDLASPEEHQKHREMAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 53174 - protein, 641 aa, Homo sapiens
MAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLISNAQDLAQEVQTVLKPVHHKEGQELTALLNTPHIQALLLAHDKVAEQEMQLEPITDERVYESIGQYGGETVKIVRIEKARDIPLGATVRNEMDSVIISRIVKGGAAEKSGLLHEGDEVLEINGIEIRGKDVNEVFDLLSDMHGTLTFVLIPSQQIKPPPAKETVIHVKAHFDYDPSDDPYVPCRELGLSFQKGDILHVISQEDPNWWQAYREGDEDNQPLAGLVPGKSFQQQREAMKQTIEEDKEPEKSGKLWCAKKNKKKRKKVLYNANKNDDYDNEEILTYEEMSLYHQPANRKRPIILIGPQNCGQNELRQRLMNKEKDRFASAVPHTTRSRRDQEVAGRDYHFVSRQAFEADIAAGKFIEHGEFEKNLYGTSIDSVRQVINSGKICLLSLRTQSLKTLRNSDLKPYIIFIAPPSQERLRALLAKEGKNPKPEELREIIEKTREMEQNNGHYFDTAIVNSDLDKAYQELLRLINKLDTEPQWVPSTWLR

SEQ ID NO: 53175 - protein, 4 aa, Homo sapiens
MAVD

SEQ ID NO: 53176 - protein, 149 aa, Homo sapiens
MAVDCPGDLGTRMMPIRRSAQLERIRQQQEDMRRRREEEGKKQELDLNSSMRLKKLAQIPPKTGIDNPMFDTEEGIVLESPHYAVKILEIEDLFSSLKHIQHTLVDSQSQEDISLLLQLVQNKDFQNAFKIHNAITVHMNKASPPFPLI

SEQ ID NO: 53177 - protein, 540 aa, Homo sapiens
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 53178 - protein, 540 aa, Homo sapiens; identical to SEQ ID NO: 53177

SEQ ID NO: 53179 - protein, 428 aa, Homo sapiens
MNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKKKMMYLTTRNAEFDRHEIQIYEEVAKMPPFQRKTLVLIGAQGVGRRSLKNRFIVLNPTRFGTTVPFTSRKPREDEKDGQAYKFVSRSEMEADIKAGKYLEHGEYEGNLYGTKIDSILEVVQTGRTCILDVNPQALKVLRTSEFMPYVVFIAAPELETLRAMHKAVVDAGITTKLLTDSDLKKTVDESARIQRAYNHYFDLIIINDNLDKAFEKLQTAIEKLRMEPQWVPISWVY

SEQ ID NO: 53180 - protein, 307 aa, Homo sapiens
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQVFVKCHFDYNPYNDNLIPCKEAGLKFSKGEILQIVNREDPNWWQASHVKEGGSAGLIPSQFLEEKRKAFVRRDWDNSGPFCGTISSKKKK

SEQ ID NO: 53181 - protein, 217 aa, Homo sapiens
MQQVLENLTELPSSTGAEEIDLIFLKGIMENPIVKSLAKAHERLEDSKLEAVSDNNLELVNEILEDITPLINVDENVAELVGILKEPHFQSLLEAHDIVASKCYDSPPSSPEMNNSSINNQLLPVDAIRILGIHKRAGEPLGVTFRVENNDLVIARILHGGMIDRQGLLHVGDIIKEVNGHEVGNNPKELQELLKNISGSVTLKILPSYRDTITPQQ

SEQ ID NO: 53182 - protein, 576 aa, Homo sapiens
MPALSTGSGSDTGLYELLAALPAQLQPHVDSQEDLTFLWDMFGEKSLHSLVKIHEKLHYYEKQSPVPILHGAAALADDLAEELQNKPLNSEIRELLKLLSKPNVKALLSVHDTVAQKNYDPVLPPMPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMESQYGHLFDKIIINDDLTVAFNELKTTFDKLETETHWVPVSWLHS

SEQ ID NO: 53183 - protein, 576 aa, Homo sapiens; identical to SEQ ID NO: 53182

SEQ ID NO: 53184 - protein, 576 aa, Homo sapiens; identical to SEQ ID NO: 53182

SEQ ID NO: 53185 - protein, 312 aa, Homo sapiens
MPALSTGSGSDTGLYELLAALPAQLQPHVDSQEDLTFLWDMFGEKSLHSLVKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHTVKHLRTLEFKPYVIFIKPPSIERLRETRKNAKIISSRDDQGAAKPFTEEDFQEMIKSAQIMESQYGHLFDKIIINDDLTVA

SEQ ID NO: 53186 - protein, 374 aa, Homo sapiens
MPEDIDDEEDSVKIIRLVKNREPLGATIKKDEQTGAIIVARIMRGGAADRSGLIHVGDELREVNGIPVEDKRPEEIIQILAQSQGAITFKIIPGSKEETPSKEGKMFIKALFDYNPNEDKAIPCKEAGLSFKKGDILQIMSQDDATWWQAKHEADANPRAGLIPSKHFQERRLALRRPEILVQPLKVSNRKSSGFRKSFRLSRKDKKTNKSMYECKKSDQYDTADVPTYEEVTPYRRQTNEKYRLVVLVGPVGVGLNELKRKLLISDTQHYGVTVPHTTRARRSQESDGVEYIFISKHLFETDVQNNKFIEYGEYKNNYYGTSIDSVRSVLAKNKVCLLDVQPHGPWFLLPLMAVPWGAKPPNARMTCGSPLDL

SEQ ID NO: 53187 - protein, 576 aa, Homo sapiens; identical to SEQ ID NO: 53182

SEQ ID NO: 53188 - protein, 289 aa, Homo sapiens
MLGWCEAIARNPHRIPNNTRTPEISGDLADASQTSTLNEKSPGRSASRSSNISKASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 53189 - protein, 272 aa, Homo sapiens
MTSSHVCCNFLNMWKKSKISTMYYLNQDAKLSNLFLQASSPTTGTAPRSQSRLSVCPSTQDICRICHCEGDEESPLITPCRCTGTLRFVHQSCLHQWIKSSDTRCCELCKYDFIMETKLKPLRKWEKLQMTTSERRKIFCSVTFHVIAITCVVWSLYVLIDRTAEEIKQGNDNGVLEWPFWTKLVVVAIGFTGGLVFMYVQCKVYVQLWRRLKAYNRVIFVQNCPDTAKKLEKNFSCNVNTDIKDAVVVPVPQTGANSLPSAEGGPPEVVSV

SEQ ID NO: 53190 - protein, 289 aa, Homo sapiens; identical to SEQ ID NO: 53188

SEQ ID NO: 53191 - protein, 141 aa, Homo sapiens
MLGWCEAIARNPHRIPNNTRTPEISGDLADASQTSTLNEKSPGRSASRSSNISKASSPTTGTAPRSQSRLSVCPSTQDICRICHCEGDEESPLITPCRCTGTLRFVHQSCLHQWIKSSDTRCCELCKYDFIMETKLKPLRK

SEQ ID NO: 53192 - protein, 808 aa, Homo sapiens
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPADQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRFGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENENSELGDGNEGSISQSQVV

SEQ ID NO: 53193 - protein, 808 aa, Homo sapiens; identical to SEQ ID NO: 53192

SEQ ID NO: 53194 - protein, 799 aa, Homo sapiens
MLHDARDRQKFFSDVQYLRDMQHKVDSEYQACLRRQEYRRDPNEKKRDQFWGQETSFERSRFSSRSSSKQSSSEEDALTEPRSSIKISAFKCDSKLPAIDQTSVKQKHKSTMTVRKAEKVDPSEPSPDQAPMVLLRKRKPNLRRFTVSPESHSPRASGDRSRQKQQWPAKVPVPRGADQVVQQEGLMCNTKLKRPNQERRNLVPSSQPMTENAPDRAKKGDPSAPSQSELHPALSQAFQGKNSPQVLSEFSGPPLTPTTVGGPRKASFRFRDEDFYSILSLNSRRESDDTEEETQSEECLWVGVRSPCSPSHHKRSRFGGTSTPQAKNKNFEENAENCRGHSSRRSEPSHGSLRISNAMEPATERPSAGQRLSQDPGLPDRESATEKDRGGSENAKKSPLSWDTKSEPRQEVGVNAENVWSDCISVEHRPGTHDSEGYWKDYLNSSQNSLDYFISGRPISPRSSVNSSYNPPASFMHSALRDDIPVDLSMSSTSVHSSDSEGNSGFHVCQPLSPIRNRTPFASAENHNYFPVNSAHEFAVREAEDTTLTSQPQGAPLYTDLLLNPQGNLSLVDSSSSSPSRMNSEGHLHVSGSLQENTPFTFFAVSHFPNQNDNGSRMAASGFTDEKETSKIKADPEKLKKLQESLLEEDSEEEGDLCRICQIAGGSPSNPLLEPCGCVGSLQFVHQECLKKWLKVKITSGADLGAVKTCEMCKQGLLVDLGDFNMIEFYQKHQQSQAQNELMNSGLYLVLLLHLYEQRFAELMRLNHNQVERERLSRNYPQPRTEENESRFWGPVLPF

SEQ ID NO: 53195 - protein, 402 aa, Homo sapiens
MSFEGGHGGSRCRGAESGDAEPPPQPPPPPPPTPPPGEPAPVPAAPRYLPPLPASPETPERAAGPSEPLGEVAPRCRGADELPPPPLPLQPAGQEVAAAGDSGEGPRRLPEAAAAKGGPGESEAGAGGERERRGAGDQPETRSVCSSRSSSSGGGDQRAGHQHQHHQPICKICFQGAEQGELLNPCRCDGSVRYTHQLCLLKWISERGSWTCELCCYRYHVIAIKMKQPCQWQSISITLVEKVQMIAVILGSLFLIASVTWLLWSAFSPYAVWQRKDILFQICYGMYGFMDLVCIGLIVHEGAAVYRVFKRWRAVNLHWDVLNYDKATDIEESSRGESSTSRTLWLPLTALRNRNLVHPTQLTSPRFQCGYVLLHLFNRMRPHEDLSEDNSSGEVVMRVTSV

SEQ ID NO: 53196 - protein, 246 aa, Homo sapiens
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEWLKDPGPRTEKRTLCCDMVCFLFITPLAAISGWLCLRGAQDHLRLHSQLEAVGLIALTIALFTIYVLWTLVSFRYHCQLYSEWRKTNQKVRLKIREADSPEGPQHSPLAAGLLKKVAEETPV

SEQ ID NO: 53197 - protein, 176 aa, Homo sapiens
MTTGDCCHLPGSLCDCSGSPAFSKVVEATGLGPPQYVAQVTSRDGRLLSTVIRALDTPSDGPFCRICHEGANGECLLSPCGCTGTLGAVHKSCLEKWLSSSNTSYCELCHTEFAVEKRPRPLTEVSFRYHCQLYSEWRKTNQKVRLKIREADSPEGPQHSPLAAGLLKKVAEETPV

SEQ ID NO: 53198 - protein, 246 aa, Homo sapiens; identical to SEQ ID NO: 53196

SEQ ID NO: 53199 - protein, 253 aa, Homo sapiens
MTTSRCSHLPEVLPDCTSSAAPVVKTVEDCGSLVNGQPQYVMQVSAKDGQLLSTVVRTLATQSPFNDRPMCRICHEGSSQEDLLSPCECTGTLGTIHRSCLEHWLSSSNTSYCELCHFRFAVERKPRPLVEWLRNPGPQHEKRTLFGDMVCFLFITPLATISGWLCLRGAVDHLHFSSRLEAVGLIALTVALFTIYLFWTLVSFRYHCRLYNEWRRTNQRVILLIPKSVNVPSNQPSLLGLHSVKRNSKETVV

SEQ ID NO: 53200 - protein, 410 aa, Homo sapiens
MLMPLCGLLWWWWCCCSGWYCYGLCAPAPQMLRHQGLLKCRCRMLFNDLKVFLLRRPPQAPLPMHGDPQPPGLAANNTLPALGAGGWAGWRGPREVVGREPPPVPPPPPLPPSSVEDDWGGPATEPPASLLSSASSDDFCKEKTEDRYSLGSSLDSGMRTPLCRICFQGPEQGELLSPCRCDGSVKCTHQPCLIKWISERGCWSCELCYYKYHVIAISTKNPLQWQAISLTVIEKVQVAAAILGSLFLIASISWLIWSTFSPSARWQRQDLLFQICYGMYGFMDVVCIGLIIHEGPSVYRIFKRWQAVNQQWKVLNYDKTKDLEDQKAGGRTNPRTSSSTQANIPSSEEETAGTPAPEQGPAQAAGHPSGPLSHHHCAYTILHILSHLRPHEQRSPPGSSRELVMRVTTV

SEQ ID NO: 53201 - protein, 278 aa, Homo sapiens
MPDQALQQMLDRSCWVCFATDEDDRTAEWVRPCRCRGSTKWVHQACLQRWVDEKQRGNSTARVACPQCNAEYLIVFPKLGPVVYVLDLADRLISKACPFAAAGIMVGSIYWTAVTYGAVTVMQVVGHKEGLDVMERADPLFLLIGLPTIPVMLILGKMIRWEDYVLRLWRKYSNKLQILNSIFPGIGCPVPRIPAEANPLADHVSATRILCGALVFPTIATIVGKLMFSSVNSNLQRTILGGIAFVAIKGAFKVYFKQQQYLRQAHRKILNYPEQEEA

SEQ ID NO: 53202 - protein, 910 aa, Homo sapiens
MDTAEEDICRVCRSEGTPEKPLYHPCVCTGSIKFIHQECLVQWLKHSRKEYCELCKHRFAFTPIYSPDMPSRLPIQDIFAGLVTSIGTAIRYWFHYTLVAFAWLGVVPLTACRIYKCLFTGSVSSLLTLPLDMLSTENLLADCLQGCFVVTCTLCAFISLVWLREQIVHGGAPIWLEHAAPPFNAAGHHQNEAPAGGNGAENVAADQPANPPAENAVVGENPDAQDDQAEEEEEDNEEEDDAGVEDAADANNGAQDDMNWNALEWDRAAEELTWERMLGLDGSLVFLEHVFWVVSLNTLFILVFAFCPYHIGHFSLVGLGFEEHVQASHFEGLITTIVGYILLAITLIICHGLATLVKFHRSRRLLGVCYIVVKVSLLVVVEIGVFPLICGWWLDICSLEMFDATLKDRELSFQSAPGTTMFLHWLVGMVYVFYFASFILLLREVLRPGVLWFLRNLNDPDFNPVQEMIHLPIYRHLRRFILSVIVFGSIVLLMLWLPIRIIKSVLPNFLPYNVMLYSDAPVSELSLELLLLQVVLPALLEQGHTRQWLKGLVRAWTVTAGYLLDLHSYLLGDQEENENSANQQVNNNQHARNNNAIPVVGEGLHAAHQAILQQGGPVGFQPYRRPLNFPLRIFLLIVFMCITLLIASLICLTLPVFAGRWLMSFWTGTAKIHELYTAACGLYVCWLTIRAVTVMVAWMPQGRRVIFQKVKEWSLMIMKTLIVAVLLAGVVPLLLGLLFELVIVAPLRVPLDQTPLFYPWQDWALGVLHAKIIAAITLMGPQWWLKTVIEQVYANGIRNIDLHYIVRKLAAPVISVLLLSLCVPYVIASGVVPLLGVTAEMQNLVHRRIYPFLLMVVVLMAILSFQVRQFKRLYEHIKNDKYLVGQRLVNYERKSGKQGSSPPPPQSSQE

SEQ ID NO: 53203 - protein, 704 aa, Homo sapiens
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTTSAGRNVGNGLNTLSDSSWRHSQVPRSSSMVLGSFGTDLMRERRDLERRTDSSISNLMDYSHRSGDFTTSSYVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRFINLARTLQAHMEDLETSEDDSEEDGDHNRTFDIA

SEQ ID NO: 53204 - protein, 704 aa, Homo sapiens; identical to SEQ ID NO: 53203

SEQ ID NO: 53205 - protein, 101 aa, Homo sapiens
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTT

SEQ ID NO: 53206 - protein, 635 aa, Homo sapiens
MESKPSRIPRRISVQPSSSLSARMMSGSRGSSLNDTYHSRDSSFRLDSEYQSTSASASASPFQSAWYSESEITQGARSRSQNQQRDHDSKRPKLSCTNCTTSAGRNVGNGLNTLSDVQDRVPSYSQGARPKENSMSTLQLNTSSTNHQLPSEHQTILSSRDSRNSLRSNFSSRESESSRSNTQPGFSYSSSRDEAPIISNSERVVSSQRPFQESSDNEGRRTTRRLLSRIASSMSSTFFSRRSSQDSLNTRSLNSENSYVSPRILTASQSRSNVPSASEVPDNRASEASQGFRFLRRRWGLSSLSHNHSSESDSENFNQESEGRNTGPWLSSSLRNRCTPLFSRRRREGRDESSRIPTSDTSSRSHIFRRESNEVVHLEAQNDPLGAAANRPQASAASSSATTGGSTSDSAQGGRNTGISGILPGSLFRFAVPPALGSNLTDNVMITVDIIPSGWNSADGKSDKTKSAPSRDPERLQKIKESLLLEDSEEEEGDLCRICQMAAASSSNLLIEPCKCTGSLQYVHQDCMKKWLQAKINSGSSLEAVTTCELCKEKLELNLEDFDIHELHRAHANEQAEYEFISSGLYLVVLLHLCEQSFSDMMGNTNEPSTRVRLQRMIPKKTETITGHLILPNFI

SEQ ID NO: 53207 - protein, 291 aa, Homo sapiens
MSMPLHQISAIPSQDAISARVYRSKTKEKEREEQNEKTLGHFMSHSSNISKAGSPPSASAPAPVSSFSRTSITPSSQDICRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 53208 - protein, 291 aa, Homo sapiens; identical to SEQ ID NO: 53207

SEQ ID NO: 53209 - protein, 291 aa, Homo sapiens; identical to SEQ ID NO: 53207

SEQ ID NO: 53210 - protein, 456 aa, Homo sapiens
  MOD_RES (1)..(1): Any amino acid
XICKDTLQASKRNSFGSEWAQALKPAKNTKARRTLKFSRSLNDVGEKAQDTSESFAYVERTCSEGKLILPQDTCLRTNRFHHKEKRTLNHKPLGNSKHSCVSCLSAGRSTASEVEAGKGGRPGLLLEEKADGEATSRSRQLLQYLFSLSHGLSASSLHRFHELESCAARLHTAKSSSGLAGSMGFCSDEMGDDDVFEDSTSAKLKSRVLRAPLCSTEKDSDLDCPSPFSEKLPPISPVSTSGDVCRICHCEGDDESPLITPCHCTGSLHFVHQACLQQWIKSSDTRCCELCKYEFIMETKLKPLRKWEKLQMTSSERRKIMCSVTFHVIAITCVVWSLYVLIDRTAEEIKQGQATGILEWPFWTKLVVVAIGFTGGLLFMYVQCKVYVQLWKRLKAYNRVIYVQNCPETSKKNIFEKSPLTEPNFENKHGYGICHSDTNSSCCTEPEDTGAEIIHV

SEQ ID NO: 53211 - protein, 89 aa, Homo sapiens
MSMPLHQISAIPSQDAISARVYRSKTKEKEREEQNEKTLGHFMSHSSNISKAGSPPSASAPAPVSSFSRTSITPSSQDICRICHCEGDD

SEQ ID NO: 53212 - protein, 346 aa, Homo sapiens
MLKSRLRMFLNELKLLVLTGGGRPRAEPQPRGGRGGGCGWAPFAGCSTRDGDGDEEEYYGSEPRARGLAGDKEPRAGPLPPPAPPLPPPGALDALSLSSSLDSGLRTPQCRICFQGPEQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 53213 - protein, 233 aa, Homo sapiens
MVSDKCHILDLIKAQRRQMLILPEGFREGSWSTLLFRATHHLALHPFLGLFGALSPTQWQAISLTVIEKVQIAAIVLGSLFLVASISWLIWSSLSPSAKWQRQDLLFQICYGMYGFMDVVCIGLIIHEGSSVYRIFKRWQAVNQQWKVLNYDKTKDIGGDAGGGTAGKSGPRNSRTGPTSGATSRPPAAQRMRTLLPQRCGYTILHLLGQLRPPDARSSSHSGREVVMRVTTV

SEQ ID NO: 53214 - protein, 1052 aa, Homo sapiens
MKLVNIWLLLLVVLLCGKKHLGDRLEKKSFEKAPCPGCSHLTLKVEFSSTVVEYEYIVAFNGYFTAKARNSFISSALKSSEVDNWRIIPRNNPSSDYPSDFEVIQIKEKQKAGLLTLEDHPNIKRVTPQRKVFRSLKYAESDPTVPCNETRWSQKWQSSRPLRRASLSLGSGFWHATGRHSSRRLLRAIPRQVAQTLQADVLWQMGYTGANVRVAVFDTGLSEKHPHFKNVKERTNWTNERTLDDGLGHGTFVAGVIASMRECQGFAPDAELHIFRVFTNNQVSYTSWFLDAFNYAILKKIDVLNLSIGGPDFMDHPFVDKVWELTANNVIMVSAIGNDGPLYGTLNNPADQMDVIGVGGIDFEDNIARFSSRGMTTWELPGGYGRMKPDIVTYGAGVRGSGVKGGCRALSGTSVASPVVAGAVTLLVSTVQKRELVNPASMKQALIASARRLPGVNMFEQGHGKLDLLRAYQILNSYKPQASLSPSYIDLTECPYMWPYCSQPIYYGGMPTVVNVTILNGMGVTGRIVDKPDWQPYLPQNGDNIEVAFSYSSVLWPWSGYLAISISVTKKAASWEGIAQGHVMITVASPAETESKNGAEQTSTVKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 53215 - protein, 497 aa, Homo sapiens
MALVGLPGHLHFCDQESGFLGRHCSGPCHDHCGFPSRDRVKKWCRTDFNSKLPIKVKIIPTPPRSKRVLWDQYHNLRYPPGYFPRDNLRMKNDPLDWNGDHIHTNFRDMYQHLRSMGYFVEVLGAPFTCFDASQYGTLLMVDSEEEYFPEEIAKLRRDVDNGLSLVIFSDWYNTSVMRKVKFYDENTRQWWMPDTGGANIPALNELLSVWNMGFSDGLYEGEFTLANHDMYYASGCSIAKFPEDGVVITQTFKDQGLEVLKQETAVVENVPILGLYQIPAEGGGRIVLYGDSNCLDDSHRQKDCFWLLDALLQYTSYGVTPPSLSHSGNRQRPPSGAGSVTPERMEGNHLHRYSKVLEAHLGDPKPRPLPACPRLSWAKPQPLNETAPSNLWKHQKLLSIDLDKVVLPNFRSNRPQVRPLSPGESGAWDIPGGIMPGRYNQEVGQTIPVFAFLGAMVVLAFFVVQINKAKSRPKRRKPRVKRPQLMQQVHPPKTPSV

SEQ ID NO: 53216 - protein, 330 aa, Homo sapiens
MIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRGVYISSI

SEQ ID NO: 53217 - protein, 519 aa, Homo sapiens
MIPVSLVVVVVGGWTVVYLTDLVLKSSVYFKHSYEDWLENNGLSISPFHIRWQTAVFNRAFYSWGRRKARMLYQWFNFGMVFGVIAMFSSFFLLGKTLMQTLAQMMADSPSSYSSSSSSSSSSSSSSSSSSSSSSSLHNEQVLQVVVPGINLPVNQLTYFFTAVLISGVVHEIGHGIAAIREQVRFNGFGIFLFIIYPGAFVDLFTTHLQLISPVQQLRIFCAGIWHNFVLALLGILALVLLPVILLPFYYTGVGVLITEVAEDSPAIGPRGLFVGDLVTHLQDCPVTNVQDWNECLDTIAYEPQIGYCISASTLQQLSFPVRAYKRLDGSTECCNNHSLTDVCFSYRNNFNKRLHTCLPARKAVEATQVCRTNKDCKKSSSSSFCIIPSLETHTRLIKVKHPPQIDMLYVGHPLHLHYTVSITSFIPRFNFLSIDLPVVVETFVKYLISLSGALAIVNAVPCFALDGQWILNSFLDATLTSVIGDNDVKDLIGFFILLGGSVLLAANVTLGLWMVTAR

SEQ ID NO: 53218 - protein, 68 aa, Homo sapiens
MHQTYSRHCRPEERWSQEGWNIPANGFNICRCLNIGMKLRLWNNLNKSNILGALKIKRREIRAPFLLP

SEQ ID NO: 53219 - protein, 253 aa, Homo sapiens
MVLLKLLEVYRKGSAGTFHKSTIFGNTIMTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGVSVLAGFT

SEQ ID NO: 53220 - protein, 267 aa, Homo sapiens
MKAEATVIPSRCARGLPSWQVLSPVQPWQTSAPQNTTQPKLLAPHQHEKSQKKSSLLKELGAFHITIALLHLVFGGYLASIVKNLHLVVLKSWYPFWGAASFLISGILAITMKTFSKTYLKMLCLMTNLISLFCVLSGLFVISKDLFLESPFESPIWRMYPNSTVHIQRLELALLCFTVLELFLPVPTAVTAWRGDCPSAKNDDACLVPNTPLHLKGLPVEPPPSYQSVIQGDAQHKQHQRLREVKQVAPDTWIVTDGAAIWTQTAN

SEQ ID NO: 53221 - protein, 267 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISFSFREVLGFASTAVIGGYPFWGGLSFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 53222 - protein, 114 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGVIQIMVGLMHIGFGIVLCLISF

SEQ ID NO: 53223 - protein, 221 aa, Homo sapiens
MMSSKPTSHAEVNETIPNPYPPSSFMAPGFQQPLGSINLENQAQGAQRAQPYGITSPGIFASSQPGQGNIQMINPSVGTAVMNFKEEAKALGFIISGSLSVSASKELSRCLVKGSLGMNIVSSILAFIGVILLLVDMCINGVAGQDYWAVLSGKGISATLMIFSLLEFFVACATAHFANQANTTTNMSVLVIPNMYESNPVTPASSSAPPRCNNYSANAPK

SEQ ID NO: 53224 - protein, 323 aa, Homo sapiens
MTEQVIGANSVPGIIAPDNVHVIQPSNPVASGNHLQPSEVTTYPISPKVIHCDTGRANLQNLLVVNQNSAAGVQSQPIGYQRQYPVGTASLQTVPGVIQYTQGTTNLQTWPGDLQNPLNANPGLTHTSNSSQWNTSFASFTSFNPKKFINEEVRTLGAIQILIGLTHIFSAINPVLYYYPFVTWLSGYPLWGGLSYIVSGSLSVWAAKDPSPCVVNSSISFNIISALFAFAGIFIIITDLSLYYVTTYSKAVSGGLLPFALLEFILTCVVSHFGCQATCCRQFENVAVIPTVFSFNPANTTTSPVNATTGPVNAATGPVSATN

SEQ ID NO: 53225 - protein, 244 aa, Homo sapiens
MDTESNRRANLALPQEPSSVPAFEVLEISPQEVSSGRLLKSASSPPLHTWLTVLKKEQEFLGVTQILTAMICLCFGTVVCSVLDISHIEGDIFSSFKAGYPFWGAIFFSISGMLSIISERRNATYLVRGSLGANTASSIAGGTGITILIINLKKSLAYIHIHSCQKFFETKCFMASFSTEIVVMMLFLTILGLGSAVSLTICGAGEELKGNKVPEDRVYEELNIYSATYSELEDPGEMSPPIDL

SEQ ID NO: 53226 - protein, 41 aa, Homo sapiens
MDTESNRRANLALPQEPSSVPAFEVLEISPQEVSSGRLLKS

SEQ ID NO: 53227 - protein, 214 aa, Homo sapiens
MASHEVDNAELGSASAHGTPGSEAGPEELNTSVYQPIDGSPDYQKAKLQVLGAIQILNAAMILALGVFLGSLQYPYHFQKHFFFFTFYTGYPIWGAVFFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 53228 - protein, 168 aa, Homo sapiens
MASHEVDNAELGSASAHGTPGSEAGPEELNTSVYQPIDGSPDYQKAKLQVLGFCSSGTLSVVAGIKPTRTWIQNSFGMNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 53229 - protein, 91 aa, Homo sapiens
MNIASATIALVGTAFLSLNIAVNIQSLRSCHSSSESPDLCNYMGSISNGMVSLLLILTLLELCVTISTIAMWCNANCCNSREEISSPPNSV

SEQ ID NO: 53230 - protein, 168 aa, Homo sapiens; identical to SEQ ID NO: 53228

SEQ ID NO: 53231 - protein, 239 aa, Homo sapiens [sequence omitted]

SEQ ID NO: 53232 - protein, 220 aa, Homo sapiens
MTTMQGMEQAMPGAGPGVPQLGNMAVIHSHLWKGLQEKFLKGEPKVLGVVQILTALMSLSMGITMMCMASNTYGSNPISVYIGYTIWGSVMFIISGSLSIAAGIRTTKGLVRGSLGMNITSSVLAASGILINTFSLAFYSFHHPYCNYYGNSNNCHGTMSILMGLDGMVLLLSVLEFCIAVSLSAFGCKVLCCTPGGVVLILPSHSHMAETASPTPLNEV

SEQ ID NO: 53233 - protein, 220 aa, Homo sapiens; identical to SEQ ID NO: 53232

SEQ ID NO: 53234 - protein, 186 aa, Homo sapiens
MHQTYSRHCRPEESTFSAAMTTMQGMEQAMPGAGPGVPQLGNMAVIHSHLWKGLQEKFLKGEPKVLGVVQILTALMSLSMGITMMCMASNTYGSNPISVYIGYTIWGSVMFIISGSLSIAAGIRTTKGLGLDGMVLLLSVLEFCIAVSLSAFGCKVLCCTPGGVVLILPSHSHMAETASPTPLNEV

SEQ ID NO: 53235 - protein, 132 aa, Homo sapiens
MTTMQGMEQTTPGAGPDVPQLGNIDVIHSYLCKGLQEKFFKRKPKVLGVVRILIALMSLSMGIIMMCVAFSSYEEHPIFVYVAYTIWGSVMYPYQLQQELEQQKVWNYLKNLSWRIMGSYLCFGERSELKPL

SEQ ID NO: 53236 - protein, 110 aa, Homo sapiens
MTTMQGMEQTTPGAGPDVPQLGNIDVIHSYLCKGLQEKFFKRKPKVLGVLCGHKFSTHSVSLSVAAGIRTTKGLELSEEFKLENNGIIFVFWREIRVETTIRRQVRRLLK

SEQ ID NO: 53237 - protein, 204 aa, Homo sapiens
MSYIHICVKDCKRSSSRGNPKSLGFCVDISFQLIRVVRILIALMSLSMGIIMMCVAFSSYEEHPIFVYVAYTIWGSVMYPYQLQQELEQQKVCIYRVLNGAQAGVQWRDLGSLQPPPPSRLPWPPKVPRVQPLPGRHPVWEVRSVSAWPPIVWDVRSPSAWLPSLESEERLCPAAIPSRKWGAPLPGHHPIWEVRSVSARPPIF

SEQ ID NO: 53238 - protein, 132 aa, Homo sapiens; identical to SEQ ID NO: 53235

SEQ ID NO: 53239 - protein, 200 aa, Homo sapiens
MDSSTAHSPVFLVFPPEITASEYESTELSATTFSTQSPLQKLFARKMKILGTIQILFGIMTFSFGVIFLFTLLKPYPRFPFIFLSGYPFWGSVLFINSGAFLIAVKRKTTETLIILSRIMNFLSALGAIAGIILLTFGFILDQNYICGYSHQNSQCKAVTVLFLGILITLMTFSIIELFISLPFSILGCHSEDCDCEQCC

SEQ ID NO: 53240 - protein, 248 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 53241 - protein, 178 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQWNSLSDADLHSAGILPSCAHCCAAVETGLL

SEQ ID NO: 53242 - protein, 180 aa, Homo sapiens
MTSQPVPNETIIVLPSNVINFSQAEKPEPTNQGQDSLKKHLHAEIKVIGFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGVSVLAGFT

SEQ ID NO: 53243 - protein, 225 aa, Homo sapiens
MTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGVSVLAGFT

SEQ ID NO: 53244 - protein, 276 aa, Homo sapiens
MVLLKLLEVYRKGSAGTFHKSTIFGNTIMTSQPVPNETIIVLPSNVINFSQAEKPEPTNQGQDSLKKHLHAEIKVIGTIQILCGMMVLSLGIILASASFSPNFTQVTSTLLNSAYPFIGPFFFIISGSLSIATEKRLTKLLVHSSLVGSILSALSALVGFIILSVKQATLNPASLQCELDKNNIPTRSYVSYFYHDSLYTTDCYTAKASLAGTLSLMLICTLLEFCLAVLTAVLRWKQAYSDFPGSVLFLPHSYIGNSGMSSKMTHDCGYEELLTS

SEQ ID NO: 53245 - protein, 248 aa, Homo sapiens; identical to SEQ ID NO: 53240

SEQ ID NO: 53246 - protein, 23 aa, Homo sapiens
MTSQPVPNETIIVLPSNVINFSQ

SEQ ID NO: 53247 - protein, 147 aa, Homo sapiens
MTSQPISNETIIMLPSNVINFSQAEKPEPTNQGQDSLKKRLQAKVKVIGVHSSLAGSILSALSALVGFILLSVNPAALNPASLQCKLDEKDIPTRLLLSYDYHSPYTMDCHRAKASLAGTLSLMLVSTVLEFCLAVLTAVLQWKQTV

SEQ ID NO: 53248 - protein, 240 aa, Homo sapiens
MLLQSQTMGVSHSFTPKGITIPQREKPGHMYQNEDYLQNGLPTETTVLGTVQILCCLLISSLGAILVFAPYPSHFNPAISTTLMSGYPFLGALCFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 53249 - protein, 195 aa, Homo sapiens
MLLQSQTMGVSHSFTPKGITIPQREKPGHMYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNNPGSSFSSTQSQDHIQQVKKSSSRSWI

SEQ ID NO: 53250 - protein, 169 aa, Homo sapiens
MLLQSQTMGVSHSFTPKGITIPQREKPGHMYQNEDYLQNGLPTETTVLGFGITGSLSIISGKQSTKPFDLSSLTSNAVSSVTAGAGLFLLADSMVALRTASQHCGSEMDYLSSLPYSEYYYPIYEIKDCLLTSVSLTGVLVVMLIFTVLELLLAAYSSVFWWKQLYSNN

SEQ ID NO: 53251 - protein, 195 aa, Homo sapiens; identical to SEQ ID NO: 53249

SEQ ID NO: 53252 - protein, 250 aa, Homo sapiens
MNSMTSAVPVANSVLVVAPHNGYPVTPGIMSHVPLYPNSQPQVHLVPGNPPSLVSNVNGQPVQKALKEGKTLGAIQIIIGLAHIGLGSIMATVLVGEYLSISFYGGFPFWGGLWFIISGSLSVAAENQPYSYCLLSGSLGLNIVSAICSAVGVILFITDLSIPHPYAYPDYYPYAWGVNPGMAISGVLLVFCLLEFGIACASSHFGCQLVCCQSSNVSVIYPNIYAANPVITPEPVTSPPSYSSEIQANK

SEQ ID NO: 53253 - protein, 849 aa, Homo sapiens
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 53254 - protein, 916 aa, Homo sapiens
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 53255 - protein, 677 aa, Homo sapiens
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMTDSEDSTVSIQIKLENEGSDEDIETDVLYSPQMALKLALTEWLQEFGVPHQYSSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGRCTRNNLFSSNILSL

SEQ ID NO: 53256 - protein, 151 aa, Homo sapiens
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAGSFLFFYLVTIQLAEIERVLCASKVMTICVISWAC

SEQ ID NO: 53257 - protein, 256 aa, Homo sapiens
AAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTGPKVVSKEIPVESIEEVSKIIKRAPVIWDNIHANDYDQKRLFLGPYKGRSTELIPRLKGVLTNPNCEFEANYVAIHTLATWYKSNMNGVRK

SEQ ID NO: 53258 - protein, 863 aa, Homo sapiens
MVQKESQATLEERESELSSNPAASAGASLEPPAAPAPGEDNPAGAGGAAVAGAAGGARRFLCGVVEGFYGRPWVMEQRKELFRRLQKWELNTYLYAPKDDYKHRMFWREMYSVEEAEQLMTLISAAREYEIEFIYAISPGLDITFSNPKEVSTLKRKLDQVSQFGCRSFALLFDDIDHNMCAADKEVFSSFAHAQVSITNEIYQYLGEPETFLFCPTEYCGTFCYPNVSQSPYLRTVGEKLLPGIEVLWTGPKVVSKEIPVESIEEVSKIIKRAPVIWDNIHANDYDQKRLFLGPYKGRSTELIPRLKGVLTNPNCEFEANYVAIHTLATWYKSNMNGVRKDVVMSRQVAHSGAKASVVDGTPLVAAPSLNATTVVTTVYQEPIMSQGAALSGEPTTLTKEEEKKQPDEEPMDMVVEKQEETDHKNDNQILSEIVEAKMAEELKPMDTDKESIAESKSPEMSMQEDCISDIAPMQTDEQTNKEQFVPGPNEKPLYTAEPVTLEDLQLLADLFYLPYEHGPKGAQMLREFQWLRANSSVVSVNCKGKDSEKIEEWRSRAAKFEEMCGLVMGMFTRLSNCANRTILYDMYSYVWDIKSIMSMVKSFVQWLGCRSHSSAQFLIGDQEPWAFRGGLAGEFQRLLPIDGANDLFFQPPPLTPTSKVYTIRPYFPKDEASVYKICREMYDDGVGLPFQSQPDLIGDKLVGGLLSLSLDYCFVLEDEDGICGYALGTVDVTPFIKKCKISWIPFMQEKYTKPNGDKELSEAEKIMLSFHEEQEVLPETFLANFPSLIKMDIHKKVTDPSVAKSMMACLLSSLKANGSRGAFCEVRPDDKRILEFYSKLGCFEIAKMEGFPKDVVILGRSL

SEQ ID NO: 53259 - protein, 746 aa, Homo sapiens
MAWIRSTCILFFTLLFAHIAAVPIKYLPEENVHDADFGEQKDISEINLAAGLDLFQGDILLQKSRNGLRDPNTRWTFPIPYILADNLGLNAKGAILYAFEMFRLKSCVDFKPYEGESSYIIFQQFDGCWSEVGDQHVGQNISIGQGCAYKAIIEHEILHALGFYHEQSRTDRDDYVNIWWDQILSGYQHNFDTYDDSLITDLNTPYDYESLMHYQPFSFNKNASVPTITAKIPEFNSIIGQRLDFSAIDLERLNRMYNCTTTHTLLDHCTFEKANICGMIQGTRDDTDWAHQDSAQAGEVDHTLLGQCTGAGYFMQFSTSSGSAEEAALLESRILYPKRKQQCLQFFYKMTGSPSDRLVVWVRRDDSTGNVRKLVKVQTFQGDDDHNWKIAHVVLKEEQKFRYLFQGTKGDPQNSTGGIYLDDITLTETPCPTGVWTVRNFSQVLENTSKGDKLQSPRFYNSEGYGFGVTLYPNSRESSGYLRLAFHVCSGENDAILEWPVENRQVIITILDQEPDVRNRMSSSMVFTTSKSHTSPAINDTVIWDRPSRVGTYHTDCNCFRSIDLGWSGFISHQMLKRRSFLKNDDLIIFVDFEDITHLSQTEVPTKGKRLSPQGLILQGQEQQVSEEGSGKAMLEEALPVSLSQGQPSRQKRSVENTGPLEDHNWPQYFRDPCDPNPCQNDGICVNVKGMASCRCISGHAFFYTGERCQAVQVHGSVLGMVIGGTAGVIFLTFSIIAILSQRPRK

SEQ ID NO: 53260 - protein, 701 aa, Homo sapiens
MDLWNLSWFLFLDALLVISGLATPENFDVDGGMDQDIFDINEGLGLDLFEGDIRLDRAQIRNSIIGEKYRWPHTIPYVLEDSLEMNAKGVILNAFERYRLKTCIDFKPWAGETNYISVFKGSGCWSSVGNRRVGKQELSIGANCDRIATVQHEFLHALGFWHEQSRSDRDDYVRIMWDRILSGREHNFNTYSDDISDSLNVPYDYTSVMHYSKTAFQNGTEPTIVTRISDFEDVIGQRMDFSDSDLLKLNQLYNCSSSLSFMDSCSFELENVCGMIQSSGDNADWQRVSQVPRGPESDHSNMGQCQGSGFFMHFDSSSVNVGATAVLESRTLYPKRGFQCLQFYLYNSGSESDQLNIYIREYSADNVDGNLTLVEEIKEIPTGSWQLYHVTLKVTKKFRVVFEGRKGSGASLGGLSIDDINLSETRCPHHIWHIRNFTQFIGSPNGTLYSPPFYSSKGYAFQIYLNLAHVTNAGIYFHLISGANDDQLQWPCPWQQATMTLLDQNPDIRQRMSNQRSITTDPFMTTDNGNYFWDRPSKVGTVALFSNGTQFRRGGGYGTSAFITHERLKSRDFIKGDDVYILLTVEDISHLNSTQIQLTPAPSVQDLCSKTTCKNDGVCTVRDGKAECRCQSGEDWWYMGERCEKRGSTRDTIVIAVSSTVAVFALMLIITLVSVYCTRKKYRERMSSNRPNLTPQNQHAF

SEQ ID NO: 53261 - protein, 297 aa, Homo sapiens
MASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 53262 - protein, 317 aa, Homo sapiens
MAEPGSRESETRARSPSVAAMASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPRDGIEPGHIPGTVNIPFTDFLSQEGLEKSPEEIRHLFQEKKVDLSKPLVATCGSGVTACHVALGAYLCGKPDVPIYDGSWVEWYMRARPEDVISEGRGKTH

SEQ ID NO: 53263 - protein, 297 aa, Homo sapiens; identical to SEQ ID NO: 53261

SEQ ID NO: 53264 - protein, 297 aa, Homo sapiens; identical to SEQ ID NO: 53261

SEQ ID NO: 53265 - protein, 297 aa, Homo sapiens; identical to SEQ ID NO: 53261

SEQ ID NO: 53266 - protein, 297 aa, Homo sapiens; identical to SEQ ID NO: 53261

SEQ ID NO: 53267 - protein, 245 aa, Homo sapiens
MASPQLCRALVSAQWVAEALRAPRAGQPLQLLDASWYLPKLGRDARREFEERHIPGAAFFDIDQCSDRTSPYDHMLPGAEHFAEYAGRLGVGAATHVVIYDASDQGLYSAPRVWWMFRAFGHHAVSLLDGGLRHWLRQNLPLSSGKSQPAPAEFRAQLDPAFIKTYEDIKENLESRRFQVVDSRATGRFRGTEPEPPAVGIEPGHIPGTVNIPFTDFLSQDGSWVEWYMRARPEDVISEGRGKTH

SEQ ID NO: 53268 - protein, 254 aa, Homo sapiens
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 53269 - protein, 184 aa, Homo sapiens
MDPAASSCMRSLQPPAPVWGCLRNPHSEGNGASGLPHYPPTPFSFHQKPDFLATATAAYPDFSASCLAATPHSLPQEEHIFTEQHPAFPQSPNWHFPVSDARRRPNSGPAGGSKEMGTSSLGLVDTTGGPGDDYGVLGSTANETEKKSSRRRKESSGQSVVPEPKDEVEACEGRSAHLPQWAGP

SEQ ID NO: 53270 - protein, 139 aa, Homo sapiens
MGTSSLGLVDTTGGPGDDYGVLGSTANETEKKSSRRRKESSDNQENRGKPEGSSKARKERTAFTKEQLRELEAEFAHHNYLTRLRRYEIAVNLDLSERQVKVWFQNRRMKWKRVKGGQPISPNGQDPEDGDSTASPSSE

SEQ ID NO: 53271 - protein, 304 aa, Homo sapiens
MEHPLFGCLRSPHATAQGLHPFSQSSLALHGRSDHMSYPELSTSSSSCIIAGYPNEEGMFASQHHRGHHHHHHHHHHHHHQQQQHQALQTNWHLPQMSSPPSAARHSLCLQPDSGGPPELGSSPPVLCSNSSSLGSSTPTGAACAPGDYGRQALSPAEAEKRSGGKRKSDSSDSQEGNYKSEVNSKPRKERTAFTKEQIRELEAEFAHHNYLTRLRRYEIAVNLDLTERQVKVWFQNRRMKWKRVKGGQQGAAAREKELVNVKKGTLLPSELSGIGAATLQQTGDSIANEDSHDSDHSSEHAHL

SEQ ID NO: 53272 - protein, 234 aa, Homo sapiens
MAASRWARKAVVLLCASDLLLLLLLLPPPGSCAAEGSPGTPDESTPPPRKKKKDIRDYNDADMARLLEQWEKDDDIEEGDLPEHKRPSAPVDFSKIDPSKPESILKMTKKGKTLMMFVTVSGSPTEKETEEITSLWQGSLFNANYDVQRFIVGSDRAIFMLRDGSYAWEIKDFLVGQDRCADVTLEGQVYPGKGGGSKEKNKTKQDKGKKKKEGDLKSRSSKEENRAGNKREDL

SEQ ID NO: 53273 - protein, 234 aa, Homo sapiens; identical to SEQ ID NO: 53272

SEQ ID NO: 53274 - protein, 397 aa, Homo sapiens
MAQSPPPQSLLGHDHWIFAQGWGWAGHWDSTSPASSSDSSGSCPCDGARGLPQPQPPSCSSRAAEAAATTPRRARTGPAGGQRQSASEREKLRMRTLARALHELRRFLPPSLAPAGQSLTKIETLRLAIRYIGHLSAVLGLSEESLQCRRRQRGDAGSPWGCPLCPDRGPAEAQTQAEGQGQGQGQGQGQGQGQGQGQGQGQGQGRRPGLVSAVLAEASWGSPSACPGAQAAPERLGRGVHDTDPWATPPYCPKIQSPPYSSQGTTSDASLWTPPQGCPWTQSSPEPRNPPVPWTAAPATLELAAVYQGLSVSPEPCLSLGAPSLLPHPSCQRLQPQTPGRCWSHSAEVVPNSEDQGPGAAFQLSEASPPQSSGLRFSGCPELWQEDLEGARLGIFY

SEQ ID NO: 53275 - protein, 335 aa, Homo sapiens
MVRRDRLRRMREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 53276 - protein, 326 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLTPVFGPYTRPSESELWDMWAGIRNNDGNLVIDSLLQYINQRKKFRRRWVGALASVTIPIHFIYGPLDPVNPYPEFLELYRKTLPRSTVSILDDHISHYPQLEDPMGFLNAYMGFINSF

SEQ ID NO: 53277 - protein, 326 aa, Homo sapiens; identical to SEQ ID NO: 53276

SEQ ID NO: 53278 - protein, 118 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIV

SEQ ID NO: 53279 - protein, 207 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRG

SEQ ID NO: 53280 - protein, 160 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLT

SEQ ID NO: 53281 - protein, 127 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGL

SEQ ID NO: 53282 - protein, 173 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGNCL

SEQ ID NO: 53283 - protein, 292 aa, Homo sapiens
MREWWVQVGLLAVPLLAAYLHIPPPQLSPALHSWKSSGKFFTYKGLRIFYQDSVGVVGSPEIVVLLHGFPTSSYDWYKIWEGLTLRFHRVIALDFLGFGFSDKPRPHHYSIFEQASIVEALLRHLGLQNRRINLLSHDYGDIVAQELLYRYKQNRSGRLTIKSLCLSNGGIFPETHRPLLLQKLLKDGGVLSPILTRLMNFFVFSRGLLQYINQRKKFRRRWVGALASVTIPIHFIYGPLDPVNPYPEFLELYRKTLPRSTVSILDDHISHYPQLEDPMGFLNAYMGFINSF

SEQ ID NO: 53284 - protein, 292 aa, Homo sapiens; identical to SEQ ID NO: 53283

SEQ ID NO: 53285 - protein, 193 aa, Homo sapiens
MDNLRETFLSLEDGLGSSDSPGLLSSWDWKDRAGPFELNQASPSQSLSPAPSLESYSSSPCPAVAGLPCEHGGASSGGSEGCSVGGASGLVEVDYNMLAFQPTHLQGGGGPKAQKGTKVRMSVQRRRKASEREKLRMRTLADALHTLRNYLPPVYSQRGQPLTKIQTLKYTIKYIGELTDLLNRGREPRAQSA

SEQ ID NO: 53286 - protein, 630 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQAPRRPLPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 53287 - protein, 622 aa, Homo sapiens
MALPTARPLLGSCGTPALGSLLFLLFSLGWVQPSRTLAGETGQEAAPLDGVLANPPNISSLSPRQLLGFPCAEVSGLSTERVRELAVALAQKNVKLSTEQLRCLAHRLSEPPEDLDALPLDLLLFLNPDAFSGPQACTRFFSRITKANVDLLPRGAPERQRLLPAALACWGVRGSLLSEADVRALGGLACDLPGRFVAESAEVLLPRLVSCPGPLDQDQQEAARAALQGGGPPYGPPSTWSVSTMDALRGLLPVLGQPIIRSIPQGIVAAWRQRSSRDPSWRQPERTILRPRFRREVEKTACPSGKKAREIDESLIFYKKWELEACVDAALLATQMDRVNAIPFTYEQLDVLKHKLDELYPQGYPESVIQHLGYLFLKMSPEDIRKWNVTSLETLKALLEVNKGHEMSPQVATLIDRFVKGRGQLDKDTLDTLTAFYPGYLCSLSPEELSSVPPSSIWAVRPQDLDTCDPRQLDVLYPKARLAFQNMNGSEYFVKIQSFLGGAPTEDLKALSQQNVSMDLATFMKLRTDAVLPLTVAEVQKLLGPHVEGLKAEERHRPVRDWILRQRQDDLDTLGLGLQGGIPNGYLVLDLSMQEALSGTPCLLGPGPVLTVLALLLASTLA

SEQ ID NO: 53288 - protein, 630 aa, Homo sapiens; identical to SEQ ID NO: 53286

SEQ ID NO: 53289 - protein, 622 aa, Homo sapiens; identical to SEQ ID NO: 53287

SEQ ID NO: 53290 - protein, 622 aa, Homo sapiens; identical to SEQ ID NO: 53287

SEQ ID NO: 53291 - protein, 593 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDCSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 53292 - protein, 536 aa, Homo sapiens
MRDSTGAGNSLVHKRSPLRRNQKTPTSLTKLSLQDGHKAKKPACKFEEGQDVLARWSDGLFYLGTIKKINILKQSCFIIFEDSSKSWVLWKDIQTGATGSGEMVCTICQEEYSEAPNEMVICDKCGQGYHQLCHTPHIDCSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMEVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 53293 - protein, 286 aa, Homo sapiens
MVCTICQEEYSEAPNEMVICDKCGQGYHQLCHTPHIDCSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKLKAERHPNLYLIQGK

SEQ ID NO: 53294 - protein, 491 aa, Homo sapiens
MVCTICQEEYSEAPNEMVICDKCGQGYHQLCHTPHIDCSVIDSDEKWLCRQCVFATTTKRGGALKKGPNAKALQVMKQTLPYSVADLEWDAGHKTNVQQCYCYCGGPGDWYLKMLQCCKCKQWFHEACVQCLQKPMLFGDRFYTFICSVCSSGPEYLKRLPLQWVDIAHLCLYNLSVIHKKKYFDSELELMTYINENWDRLHPGELADTPKSERYEHVLEALNDYKTMFMSGKEIKKKKHLFGLRIRVPPVPPNVAFKAEKEPEGTSHEFKIKGRKASKPISDSREVSNGIEKKGKKKSVGRPPGPYTRKMIQKTAEPLLDKESISENPTLDLPCSIGRTEGTAHSSNTSDVDFTGASSAKETTSSSISRHYGLSDSRKRTRTGRSWPAAIPHLRRRRGRLPRRALQTQNSEIVKDDEGKEDYQFDELNTEILNNLADQELQLNHLKNSITSYFGAAGRIACGEKYRVLARRVTLDGKVQYLVEWEGATAS

SEQ ID NO: 53295 - protein, 491 aa, Homo sapiens; identical to SEQ ID NO: 53294

SEQ ID NO: 53296 - protein, 396 aa, Homo sapiens
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 53297 - protein, 333 aa, Homo sapiens
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSRELLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 53298 - protein, 243 aa, Homo sapiens
MERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGTDA

SEQ ID NO: 53299 - protein, 397 aa, Homo sapiens
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREQARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGSITPTDYTLSKCYLPREDVVLIIYCGVVGFLVVLTLTHFGLLASPFLSGLNLLGKRKTR

SEQ ID NO: 53300 - protein, 341 aa, Homo sapiens
MAMIELGFGRQNFHPLKRKSSLLLKLIAVVFAVLLFCEFLIYYLAIFQCNWPEVKTTASDGEQTTREPVLKAMFLADTHLLGEFLGHWLDKLRREWQMERAFQTALWLLQPEVVFILGDIFDEGKWSTPEAWADDVERFQKMFRHPSHVQLKVVAGNHDIGFHYEMNTYKVERFEKVFSSERLFSWKGINFVMVNSVALNGDGCGICSETEAELIEVSHRLNCSREQARGSSRCGPGPLLPTSAPVLLQHYPLYRRSDANCSGEDAAPAEERDIPFKENYDVLSREASQKLLWWLQPRLVLSGHTHSACEVHHGGRVPELSVPSFSWRNRNNPSFIMGTDA

SEQ ID NO: 53301 - protein, 396 aa, Homo sapiens; identical to SEQ ID NO: 53296

SEQ ID NO: 53302 - protein, 119 aa, Homo sapiens
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDF

SEQ ID NO: 53303 - protein, 220 aa, Homo sapiens
MPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 53304 - protein, 326 aa, Homo sapiens
MWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 53305 - protein, 168 aa, Homo sapiens
MADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 53306 - protein, 326 aa, Homo sapiens; identical to SEQ ID NO: 53304

SEQ ID NO: 53307 - protein, 74 aa, Homo sapiens
MWRSRWDASVLKAEALALLPCGLGMAFSQSHVMAARRHQHSRLIIEVDEYSSNPTQAFTFYNINQGRFQPPHVQ

SEQ ID NO: 53308 - protein, 359 aa, Homo sapiens
MNGRETQSVSRSGGGPGCGGGSGGRCRGGRRRSMWRSRWDASVLKAEALALLPCGLGMAFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 53309 - protein, 326 aa, Homo sapiens; identical to SEQ ID NO: 53304

SEQ ID NO: 53310 - protein, 304 aa, Homo sapiens
MWRSFSQSHVMAARRHQHSRLIIEVDEYSSNPTQAFTFYNINQGRFQPPHVQMVDPVPHDAPKPPGYTRFVCVSDTHSRTDPIQMPYGDVLIHAGDFTELGLPSEVKKFNEWLGSLPYEYKIVIAGNHELTFDQEFMADLIKQDFYYFPSVSKLKPENYENVQSLLTNCIYLQDSEVTVRGFRIYGSPWQPWFYGWGFNLPRGQALLEKWNLIPEGVDILITHGPPLGFLDWVPKKMQRVGCVELLNTVQRRVQPRLHVFGHIHEGYGVMADGTTTYVNASVCTVNYQPVNPPIVIDLPTPRNS

SEQ ID NO: 53311 - protein, 294 aa, Homo sapiens
MAHGIPSQGKVTITVDEYSSNPTQAFTHYNINQSRFQPPHVHMVDPIPYDTPKPAGHTRFVCISDTHSRTDGIQMPYGDILLHTGDFTELGLPSEVKKFNDWLGNLPYEYKIVIAGNHELTFDKEFMADLVKQDYYRFPSVSKLKPEDFDNVQSLLTNSIYLQDSEVTVKGFRIYGAPWTPWFNGWGFNLPRGQSLLDKWNLIPEGIDILMTHGPPLGFRDWVPKELQRVGCVELLNTVQRRVRPKLHVFGGIHEGYGIMTDGYTTYINASTCTVSFQPTNPPIIFDLPNPQGS

SEQ ID NO: 53312 - protein, 277 aa, Homo sapiens
MAHGIPSQGKVTITVDEYSSNPTQAFTHYNINQSRFQPPHVHMVDPIPYDTPKPAGHTRFVCISDTHSRTDGIQMPYGDILLHTGDFTELGLPSEVKKFNDWLGNLPYEYKIVIAGNHELTFDKEFMADLVKQDYYRFPSVSKLKPEDFDNVQSLLTNSIYLQDSEVTVKGFRIYGAPWTPWFNGWGFNLPRGQSLLDKWNLIPEGIDILMTHGPPLGFRDWVPKELQRVGCVELLNTVQRRVRPKLHVFGGIHEVNPVSISKALRTKICSLPSKTS

SEQ ID NO: 53313 - protein, 43 aa, Homo sapiens
MAHGIPSQGKVTITVDEYSSNPTQAFTHYNINQSRFQPPHVHM

SEQ ID NO: 53314 - protein, 61 aa, Homo sapiens
MDPNCSCATGGSCTCTGSCKCKECKCTSCKKSCCSCCPMSCAKCAQGCICKGASEKCSCCA

SEQ ID NO: 53315 - protein, 61 aa, Homo sapiens
MDPNCSCTTGGSCACAGSCKCKECKCTSCKKCCCSCCPVGCAKCAQGCVCKGSSEKCRCCA

SEQ ID NO: 53316 - protein, 61 aa, Homo sapiens
MDPNCSCATGGSCTCAGSCKCKECKCTSCKKSCCSCCPVGCAKCAQGCVCKGASEKCSCCA

SEQ ID NO: 53317 - protein, 127 aa, Homo sapiens
MDPNCSCATGGSCTCAGSCKCKECKCTSCKKSECGAISRNLGLWLRLGGNSRLALSASFWGTGLSLPSLPVSFPLQAFCPKFRWGRTAFFSWDTNPNCTPYGFRTELCQTKKSILWVWVLSSSQACY

SEQ ID NO: 53318 - protein, 61 aa, Homo sapiens
MDPNCSCAAGVSCTCAGSCKCKECKCTSCKKSCCSCCPVGCSKCAQGCVCKGASEKCSCCD

SEQ ID NO: 53319 - protein, 62 aa, Homo sapiens
MDPNCSCAAAGVSCTCAGSCKCKECKCTSCKKSCCSCCPVGCSKCAQGCVCKGASEKCSCCD

SEQ ID NO: 53320 - protein, 62 aa, Homo sapiens
MDPNCSCAAAGVSCTCASSCKCKECKCTSCKKSCCSCCPVGCAKCAQGCICKGASEKCSCCA

SEQ ID NO: 53321 - protein, 61 aa, Homo sapiens
MDPNCSCAAGVSCTCASSCKCKECKCTSCKKSCCSCCPVGCAKCAQGCICKGASEKCSCCA

SEQ ID NO: 53322 - protein, 61 aa, Homo sapiens
MDPNCSCEAGGSCACAGSCKCKKCKCTSCKKSCCSCCPLGCAKCAQGCICKGASEKCSCCA

SEQ ID NO: 53323 - protein, 61 aa, Homo sapiens
MDPNCSCSPVGSCACAGSCKCKECKCTSCKKSCCSCCPVGCAKCAQGCICKGTSDKCSCCA

SEQ ID NO: 53324 - protein, 61 aa, Homo sapiens
MDPNCSCAAGDSCTCAGSCKCKECKCTSCKKSCCSCCPVGCAKCAQGCICKGASDKCSCCA

SEQ ID NO: 53325 - protein, 68 aa, Homo sapiens
MDPETCPCPSGGSCTCADSCKCEGCKCTSCKKSCCSCCPAECEKCAKDCVCKGGEAAEAEAEKCSCCQ

SEQ ID NO: 53326 - protein, 62 aa, Homo sapiens
MDPRECVCMSGGICMCGDNCKCTTCNCKTYWKSCCPCCPPGCAKCARGCICKGGSDKCSCCP

SEQ ID NO: 53327 - protein, 508 aa, Homo sapiens
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAGYCDCFASGDFCNNCNCNNCCNNLHHDIERFKAIKACLGRNPEAFQPKIGKGQLGNVKPQHNKGCNCRRSGCLKNYCECYEAQIMCSSICKCIGCKNYEESPERKTLMSMPNYMQTGGLEGSHYLPPTKFSGLPRFSHDRRPSSCISWEVVEATCACLLAQGEEAEKEHCSKCLAEQMILEEFGRCLSQILHTEFKSKGLKME

SEQ ID NO: 53328 - protein, 251 aa, Homo sapiens
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSA

SEQ ID NO: 53329 - protein, 306 aa, Homo sapiens
MEEGPLPGGLPSPEDAMVTELLSPEGPFASENIGLKAPVKYEEDEFHVFKEAYLGPADPKEPVLHAFNPALGADCKGQVKAKLAGGDSDGGELLGEYPGIPELSALEDVALLQAPQPPACNVHFLSSLLPAHRSPAVLPLGAWVLEGASHPGVRMIPVEIKEAGGTTTSNNPEEATLQNLLAQESCCKFPSSQELEDASCCSLKKDSNPMVICQLKGGTQMLCIDNSRTRELKALHLVPQYQDQNNYLQSDVPKPMTALVGRFLPASTKLNLITQQLEGALPSVVNGSAFPSGSTLPGPPKITLAG

SEQ ID NO: 53330 - protein, 753 aa, Homo sapiens
MGEHSPDNNIIYFEAEEDELTPDDKMLRFVDKNGLVPSSSGTVYDRTTVLIEQDPGTLEDEDDDGQCGEHLPFLVGGEEGFHLIDHEAMSQGYVQHIISPDQIHLTINPGSTPMPRNIEGATLTLQSECPETKRKEVKRYQCTFEGCPRTYSTAGNLRTHQKTHRGEYTFVCNQEGCGKAFLTSYSLRIHVRVHTKEKPFECDVQGCEKAFNTLYRLKAHQRLHTGKTFNCESEGCSKYFTTLSDLRKHIRTHTGEKPFRCDHDGCGKAFAASHHLKTHVRTHTGERPFFCPSNGCEKTFSTQYSLKSHMKGHDNKGHSYNALPQHNGSEDTNHSLCLSDLSLLSTDSELRENSSTTQGQDLSTISPAIIFESMFQNSDDTAIQEDPQQTASLTESFNGDAESVSDVPPSTGNSASLSLPLVLQPGLSEPPQPLLPASAPSAPPPAPSLGPGSQQAAFGNPPALLQPPEVPVPHSTQFAANHQEFLPHPQAPQPIVPGLSVVAGASASAAAVASAVAAPAPPQSTTEPLPAMVQTLPLGANSVLTNNPTITITPTPNTAILQSSLVMGEQNLQWILNGATSSPQNQEQIQQASKVEKVFFTTAVPVASSPGSSVQQIGLSVPVIIIKQEEACQCQCACRDSAKERASSRRKGCSSPPPPEPSPQAPDGPSLQLPAQTFSSAPVPGSSSSTLPSSCEQSRQAETPSDPQTETLSAMDVSEFLSLQSLDTPSNLIPIEALLQGEEEMGLTSSFSK

SEQ ID NO: 53331 - protein, 200 aa, Homo sapiens
KQSQVKRYQCTFEGCPRTYSTAGNLRTHQKTHRGEYTFVCNQEGCGKAFLTSYSLRIHVRVHTKEKPFECDVQGCEKAFNTLYRLKAHQRLHTGKTFNCESEGCSKYFTTLSDLRKHIRTHTGEKPFRCDHDGCGKAFAASHHLKTHVRTHTGERPFFCPSNGCEKTFSTQYSLKSHMKGHDNKGHSYNALPQHNGSEST

SEQ ID NO: 53332 - protein, 852 aa, Homo sapiens
MLITERKHFRSGRIAQSMSEANLIDMEAGKLSKSCNITECQDPDLLHNWPDAFTLRGNNASKVANPFWNQLSASNPFLDDITQLRNNRKRNNISILKEDPFLFCREIENGNSFDSSGDELDVHQLLRQTSSRNSGRSKSVSELLDILDDTAHAHQSIHNSDQILLHDLEWLKNDREAYKMAWLSQRQLARSCLDLNTISQSPGWAQTQLAEVTIACKVNHQGGSVQLPESDITVHVPQGHVAVGEFQEVSLRAFLDPPHMLNHDLSCTVSPLLEIMLGNLNTMEALLLEMKIGAEVRKDPFSQVMTEMVCLHSLGKEGPFKVLSNCYIYKDTIQVKLIDLSQVMYLVVAAQAKALPSPAATIWDYIHKTTSIGIYGPKYIHPSFTVVLTVCGHNYMPGQLTISDIKKGGKNISPVVFQLWGKQSFLLDKPQDLSISIFSCDPDFEVKTEGERKEIKQKQLEAGEVVHQQFLFSLVEHREMHLFDFCVQVEPPNGEPVAQFSITTPDPTPNLKRLSNLPGYLQKKEEIKSAPLSPKILVKYPTFQDKTLNFSNYGVTLKAVLRQSKIDYFLEYFKGDTIALLGEGKVKAIGQSKVKEWYVGVLRGKIGLVHCKNVKVISKEQVMFMSDSVFTTRNLLEQIVLPLKKLTYIYSVVLTLVSEKVYDWKVLADVLGYSHLSLEDFDQIQADKESEKVSYVIKKLKEDCHTERNTRKFLYELIVALLKMDCQELVARLIQEAAVLTSAVKLGKGWRELAEKLVRLTKQQMEAYEIPHRGNTGDVAVEMMWKPAYDFLYTWSAHYGNNYRDVLQDLQSALDRMKNPVTKHWRELTGVLILVNSLEVLRVTAFSTSEEV

SEQ ID NO: 53333 - protein, 852 aa, Homo sapiens; identical to SEQ ID NO: 53332

SEQ ID NO: 53334 - protein, 435 aa, Homo sapiens
MLLGGPPRSPRSGTSPKGPWSSTGHVQFGKSPQTWPRRTRPRSPEPAAPSGVRGSTWTRRRDTPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 53335 - protein, 466 aa, Homo sapiens
MLLGGPPRSPRSGTSPKGPWSSTGHVQFGKSPQTWPRRTRPRSPEPAAPSGVRGSTWTRRRDTPRRAGPTALSRYVGHLWMGRRPPSPEARGPVPRSSAASRARRSLASPGISPGPLTATIGGAVAGGGPRQGRAEAHKEVFPGQRVGKMAAPMELFCWSGGWGLPSVDLDSLAVLTYARFTGAPLKVHKISNPWQSPSGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPGTRTLGMAEEDEEE

SEQ ID NO: 53336 - protein, 316 aa, Homo sapiens
  MOD_RES (1)..(1): Any amino acid
XEGGQDGGAHGAVLLVRGLGAAVSGPGQPGRADLCQIYWCSTEGTQDQQPLAEPFRYPVSLGGTLPALRTSHGEVISVPHKIITHLRKEKYNADYDLSARQGADTLAFMSLLEEKLLPVLVHTFWIDTKNYVEVTRKWYAEAMPFPLNFFLPGRMQRQYMERLQLLTGEHRPEDEEELEKELYREARECLTLLSQRLGSQKFFFGDAPASLDAFVFSYLALLLQAKLPSGKLQVHLRGLHNLCAYCTHILSLYFPWDGAEVPPQRQTPAGPETEEEPYRRRNQILSVLAGLAAMVGYALLSGIVSIQRATPARAPG

SEQ ID NO: 53337 - protein, 395 aa, Homo sapiens
MNGPVDGLCDHSLSEGVFMFTSESVGEGHPDKICDQISDAVLDAHLKQDPNAKVACETVCKTGMVLLCGEITSMAMVDYQRVVRDTIKHIGYDDSAKGFDFKTCNVLVALEQQSPDIAQCVHLDRNEEDVGAGDQGLMFGYATDETEECMPLTIILAHKLNARMADLRRSGLLPWLRPDSKTQVTVQYMQDNGAVIPVRIHTIVISVQHNEDITLEEMRRALKEQVIRAVVPAKYLDEDTVYHLQPSGRFVIGGPQGDAGVTGRKIIVDTYGGWGAHGGGAFSGKDYTKVDRSAAYAARWVAKSLVKAGLCRRVLVQVSYAIGVAEPLSISIFTYGTSQKTERELLDVVHKNFDLRPGVIVRDLDLKKPIYQKTACYGHFGRSEFPWEVPRKLVF

SEQ ID NO: 53338 - protein, 395 aa, Homo sapiens; identical to SEQ ID NO: 53337

SEQ ID NO: 53339 - protein, 145 aa, Homo sapiens
ESVGEGHPDKICDQISDAVLDAHLKQDPNAKVACGFDFKTCNVLVALEQQSPDIAQCVHLDRNEEDVGAGDQGLMFGYATDETEECMPLTIILAHKLNARMADLRRSGLLPWLRPDSKTQVTVQYMQDNGAVIPVRIHTIVISVQ

SEQ ID NO: 53340 - protein, 395 aa, Homo sapiens
MNGQLNGFHEAFIEEGTFLFTSESVGEGHPDKICDQISDAVLDAHLQQDPDAKVACETVAKTGMILLAGEITSRAAVDYQKVVREAVKHIGYDDSSKGFDYKTCNVLVALEQQSPDIAQGVHLDRNEEDIGAGDQGLMFGYATDETEECMPLTIVLAHKLNAKLAELRRNGTLPWLRPDSKTQVTVQYMQDRGAVLPIRVHTIVISVQHDEEVCLDEMRDALKEKVIKAVVPAKYLDEDTIYHLQPSGRFVIGGPQGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 53341 - protein, 176 aa, Homo sapiens
MNGQLNGFHEAFIEEGTFLFTSESVGEGHPDKICDQIGDAGLTGRKIIVDTYGGWGAHGGGAFSGKDYTKVDRSAAYAARWVAKSLVKGGLCRRVLVQVSYAIGVSHPLSISIFHYGTSQKSERELLEIVKKNFDLRPGVIVRDLDLKKPIYQRTAAYGHFGRDSFPWEVPKKLKY

SEQ ID NO: 53342 - protein, 182 aa, Homo sapiens
MARLLWLLRGLTLGTAPRRAVRGQAGGGGPGTGPGLGEAGSLATCELPLAKSEWQKKLTPEQFYVTREKGTEPPFSGIYLNNKEAGMYHCVCCDSPLFSSEKKYCSGTGWPSFSEAHGTSGSDESHTGILRRLDTSLGSARTEVVCKQCEAHLGHVFPDGPGPNGQRFCINSVALKFKPRKH

SEQ ID NO: 53343 - protein, 185 aa, Homo sapiens
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 53344 - protein, 192 aa, Homo sapiens
MSPRRTLPRPLSLCLSLCLCLCLAAALGSAQSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADSSGTAEGGSGVASPAQADKAEL

SEQ ID NO: 53345 - protein, 164 aa, Homo sapiens
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDFSYGMHRVETSCSQCGAHLGHIFDDGPRPTGKRYCINSAALSFTPADS

SEQ ID NO: 53346 - protein, 185 aa, Homo sapiens; identical to SEQ ID NO: 53343

SEQ ID NO: 53347 - protein, 117 aa, Homo sapiens
MSAFNLLHLVTKSQPVALRACGLPSGSCRDKKNCKVVFSQQELRKRLTPLQYHVTQEKGTESAFEGEYTHHKDPGIYKCVVCGTPLFKSETKFDSGSGWPSFHDVINSEAITFTDDF

SEQ ID NO: 53348 - protein, 900 aa, Homo sapiens
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQAKTSPKPAVVETVTTAKPQQIQALMDEVTKQGNIVRELKAQKADKNEVAAEVAKLLDLKKQLAVAEGKPPEAPKGKKKK

SEQ ID NO: 53349 - protein, 635 aa, Homo sapiens
MAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQVDLYQFMAKDNVPFHSLVFPCSALGAEDNYTLVSHLIATEYLNYEDGKFSKSRGVGVFGDMAQDTGIPADIWRFYLLYIRPEGQDSAFSWTDLLLKNNSELLNNLGNFINRAGMFVSKFFGGYVPEMVLTPDDQRLLAHVTLELQHYHQLLEKVRIRDALRSILTISRHGNQYIQVNEPWKRIKGSEADRQRAGTVTGLAVNIAALLSVMLQPYMPTVSATIQAQLQLPPPACSILLTNFLCTLPAGHQIGTVSPLFQKLENDQIESLRQRFGGGQVRKLKAVPSLHNSHSITSLISLSSPHPSLFPSFGPAASSLTVFLSCLN

SEQ ID NO: 53350 - protein, 546 aa, Homo sapiens
MRLFVSDGVPGCLPVLAAAGRARGRAEVLISTVGPEDCVVPFLTRPKVPVLQLDSGNYLFSTSAICRYFFLLSGWEQDDLTNQWLEWEATELQPALSAALYYLVVQGKKGEDVLGSVRRALTHIDHSLSRQNCPFLAGETESLADIVLWGALYPLLQDPAYLPEELSALHSWFQTLSTQEPCQRAAETVLKQQGVLALRPYLQKQPQPSPAEGRAVTNEPEEEELATLSEEEIAMAVTAWEKGLESLPPLRPQQNPVLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKLEKRLEEWLGRTLPGSDWTPNAQFITRSWLRDGLKPRCITRDLKWGTPVPLEGFEDKVFYVWFDATIGYLSITANYTDQWERWWKNPEQP

SEQ ID NO: 53351 - protein, 593 aa, Homo sapiens
MLRTSVLRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISCTDFIRTTEARHRVAVQHFWGVLKSRGLLYKGVYEGWYCASDECFLPEAKVTQQPGPSGDSFPVSLESGHPVSWTKEENYIFRLSQFRKPLQRWLRGNPQAITPEPFHHVVLQWLDEELPDLSVSRRSSHLHWGIPVPGDDSQTIYVWLDALVNYLTVIGYPNAEFKSWWPATSHIIGKDILKFHAIYWPAFLLGAGMSPPQRICVHSHWTVCGQKMSKSLGNVVDPRTCLNRYTVDGFRYFLLRQGVPNWDCDYYDEKVVKLLNSELADALGGLLNRCTAKRINPSETYPAFCTTCFPSEPGLVGPSVRAQAEDYALVSAVATLPKQVADHYDNFRIYKALEAVSSCVRQTNGFVQRHAPWKLNWESPVDAPWLGTVLHVALECLRVFGTLLQPVTPSLADKLLSRLGVSASERSLGELYFLPRFYGHPCPFEGRRLGPETGLLFPRLDQSRTWLVKAHRT

SEQ ID NO: 53352 - protein, 520 aa, Homo sapiens
MLRTSVLRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISWTKEENYIFRLSQFRKPLQRWLRGNPQAITPEPFHHVVLQWLDEELPDLSVSRRSSHLHWGIPVPGDDSQTIYVWLDALVNYLTVIGYPNAEFKSWWPATSHIIGKDILKFHAIYWPAFLLGAGMSPPQRICVHSHWTVCGQKMSKSLGNVVDPRTCLNRYTVDGFRYFLLRQGVPNWDCDYYDEKVVKLLNSELADALGGLLNRCTAKRINPSETYPAFCTTCFPSEPGLVGPSVRAQAEDYALVSAVATLPKQVADHYDNFRIYKALEAVSSCVRQTNGFVQRHAPWKLNWESPVDAPWLGTVLHVALECLRVFGTLLQPVTPSLADKLLSRLGVSASERSLGELYFLPRFYGHPCPFEGRRLGPETGLLFPRLDQSRTWLVKAHRT

SEQ ID NO: 53353 - protein, 486 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPLLPPLPPPPPEPESSEDPTSPPEPQDLSSSVCKEEKMPRGGSLESDGCPKEPAKTQPAVATAATAAEKYKHRGEGERKDIVSSSMPRPNREEPVDSRTPVTERVS

SEQ ID NO: 53354 - protein, 271 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRSPRAPRTPPAPLSPRT

SEQ ID NO: 53355 - protein, 50 aa, Homo sapiens
MVAGMLGLREEKSEDQDLQGLKDKPLKFKKVKKDKKEEKEGKHEPVQPSA

SEQ ID NO: 53356 - protein, 498 aa, Homo sapiens [sequence omitted]

SEQ ID NO: 53357 - protein, 394 aa, Homo sapiens
MVAGMLGLREEKSEDQDLQGLKDKPLKFKKVKKDKKEEKEGKHEPVQPSAHHSAEPAEAGKAETSEGSGSAPAVPEASASPKQRRSIIRDRGPMYDDPTLPEGWTRKLKQRKSGRSAGKYDVYLINPQGKAFRSKVELIAYFEKVGDTSLDPNDFDFTVTGRGSPSRREQKPPKKPKSPKAPGTGRGRGRPKGSGTTRPKAATSEGVQVKRVLEKSPGKLLVKMPFQTSPGGKAEGGGATTSTQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHSESPKAPVPTRIKAAVVSSPYG

SEQ ID NO: 53358 - protein, 605 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 53359 - protein, 586 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPSLQGRHSGREDGCKVWETEDTVEPTSTSWNPRGWPGTHVSLSPPPASMMWVSCRRSWCPSSQS

SEQ ID NO: 53360 - protein, 550 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVEPTTQPQYSGNFDNDLYEIYLIDI

SEQ ID NO: 53361 - protein, 549 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 53362 - protein, 503 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRSKDLKKPGARKQ

SEQ ID NO: 53363 - protein, 556 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 53364 - protein, 605 aa, Homo sapiens; identical to SEQ ID NO: 53358

SEQ ID NO: 53365 - protein, 503 aa, Homo sapiens; identical to SEQ ID NO: 53362

SEQ ID NO: 53366 - protein, 549 aa, Homo sapiens; identical to SEQ ID NO: 53361

SEQ ID NO: 53367 - protein, 605 aa, Homo sapiens; identical to SEQ ID NO: 53358

SEQ ID NO: 53368 - protein, 656 aa, Homo sapiens
MGGFRLRTGRNAALNSDRLLLLPVASMAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRHLAHRLRRRHQRCQRRTPLAVAPPTGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 53369 - protein, 536 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRSKDLKKPGARKQ

SEQ ID NO: 53370 - protein, 630 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRHLAHRLRRRHQRCQRRTPLAVAPPTGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRSKDLKKPGARKQ

SEQ ID NO: 53371 - protein, 567 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPRYYHLALDWKCNCGYHLCCRSVLVP

SEQ ID NO: 53372 - protein, 535 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQAVDPGLPSVKQEPPDPEEDKEENKDDSASKLAPEEEAGGAGTPVITEIFSLGGTRFRDTAVWLPRAGTREGKMDVKCGRPRTQWSPRARAGTHEDGLEPMSVSHHLQLR

SEQ ID NO: 53373 - protein, 655 aa, Homo sapiens
MAEDWLDCPALGPGWKRREVFRKSGATCGRSDTYYQSPTGDRIRSKVELTRYLGPACDLTLFDFKQGILCYPAPKAHPVAVASKKRKKPSRPAKTRKRQVGPQSGEVRKEAPRDETKADTDTAPASFPAPGCCENCGISFSGDGTQRQRLKTLCKDCRAQRIAFNREQRMFKRVGCGECAACQVTEDCGACSTCLLQLPHDVASGLFCKCERRRCLRIVERSRGCGVCRGCQTQEDCGHCPICLRPPRPGLRRQWKCVQRRCLRGKHARRKGGCDSKMAARRRPGAQPLPPPPPSQSPEPTEPHPRALAPSPPAEFIYYCVDEDELQPYTNRRQNRKCGACAACLRRMDCGRCDFCCDKPKFGGSNQKRQKCRWRQCLQFAMKRLLPSVWSESEDGAGSPPPYRRRKRPSSARRHHLGPTLKPTLATRTAQPDHTQAPTKQEAGGGFVLPPPGTDLVFLREGASSPVQVPGPVAASTEALLQEAQCSGLSWVVALPQVKQEKADTQDEWTPGTAVLTSPVLVPGCPSKAVDPGLPSVKQEPPDPEEDKEENKDDSASKLAPEEEAGGAGTPVITEIFSLGGTRFRDTAVWLPSLQGRHSGREDGCKVWETEDTVEPTSTSWNPRGWPGTHVSLSPPPASMMWVSCRRSWCPSSQS

SEQ ID NO: 53374 - protein, 411 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQPVTKVTNHPSNKVKSDPQRMNEQPRQLFWEKRLQGLSASDVTEQIIKTMELPKGLQGVGPGSNDETLLSAVASALHTSSAPITGQVSAAVEKNPAVWLNTSQPLCKAFIVTDEDIRKQEERVQQVRKKLEEALMADILSRAADTEEMDIEMDSGDEA

SEQ ID NO: 53375 - protein, 302 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKLRWNTHRPAPWHALSRLCLLIRCLLCLECAYPLPLHLVNSYSSKTQLHCLHLWEACPAYSRQNQSFPP

SEQ ID NO: 53376 - protein, 302 aa, Homo sapiens; identical to SEQ ID NO: 53375

SEQ ID NO: 53377 - protein, 291 aa, Homo sapiens
MERKRWECPALPQGWEREEVPRRSGLSAGHRDVFYYSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 53378 - protein, 259 aa, Homo sapiens
MERKSPSGKKFRSKPQLARYLGGSMDLSTFDFRTGKMLMSKMNKSRQRVRYDSSNQVKGKPDLNTALPVRQTASIFKQPVTKITNHPSNKVKSDPQKAVDQPRQLFWEKKLSGLNAFDIAEELVKTMDLPKGLQGVGPGCTDETLLSAIASALHTSTMPITGQLSAAVEKNPGVWLNTTQPLCKAFMVTDEDIRKQEELVQQVRKRLEEALMADMLAHVEELARDGEAPLDKACAEDDDEEDEEEEEEEPDPDPEMEHV

SEQ ID NO: 53379 - protein, 1494 aa, Homo sapiens
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNPGFHGAPNSSPIHLNRTPLSPPSVMLHGSPVQSSCAMAGRTNIPLSPTLTTKSPVMKKPMCNFSTNMEIPRAMFHHKPPQGPPPPPPPSCALQKKPLTSEKDPLGILDPIPSKPVNQNPVIINPTSFHSNVHSQVPMMNVSMPPAVVPLPSNLPLPTVKPGHMNHGSHVQRVQHSASTSLSPSPVTSPVHMMGTGIGRIEASPQRSRSSSTSSDHGNFMMPPVGPQATSSGIKVPPRSPRSTIGSPRPSMPSSPSTKSDGHHQYKDIPNPLIAGISNVLNTPSSAAFPTASAGSSSVKSQPGLLGMPLNQILNQHNAASFPASSLLSAAAKAQLANQNKLAGNNSSSSSNSGAVAGSGNTEGHSTLNTMFPPTANMLLPTGEGQSGRAALRDKLMSQQKDALRKRKQPPTTVLSLLRQSQMDSSAVPKPGPDLLRKQGQGSFPISSMSQLLQSMSCQSSHLSSNSTPGCGASNTALPCSANQLHFTDPSMNSSVLQNIPLRGEAVHCHNANTNFVHSNSPVPNHHLAGLINQIQASGNCGMLSQSGMALGNSLHPNPPQSRISTSSTPVIPNSIVSSYNQTSSEAGGSGPSSSIAIAGTNHPAITKTTSVLQDGVIVTTAAGNPLQSQLPIGSDFPFVGQEHALHFPSNSTSNNHLPHPLNPSLLSSLPISLPVNQQHLLNQNLLNILQPSAGEGDMSSINNTLSNHQLTHLQSLLNNNQMFPPNQQQQQLLQGYQNLQAFQGQSTIPCPANNNPMACLFQNFQVRMQEDAALLNKRISTQPGLTALPENPNTTLPPFQDTPCELQPRIDPSLGQQVKDGLVVGGPGDASVDAIYKAVVDAASKGMQVVITTAVNSTTQISPIPALSAMSAFTASIGDPLNLSSAVSAVIHGRNMGGVDHDGRLRNSRGARLPKNLDHGKNVNEGDGFEYFKSASCHTSKKQWDGEQSPRGERNRWKYEEFLDHPGHIHSSPCHERPNNVSTLPFLPGEQHPILLPPRNCPGDKILEENFRYNNYKRTMMSFKERLENTVERCAHINGNRPRQSRGFGELLSTAKQDLVLEEQSPSSSNSLENSLVKDYIHYNGDFNAKSVNGCVPSPSDAKSISSEDDLRNPDSPSSNELIHYRPRTFNVGDLVWGQIKGLTSWPGKLVREDDVHNSCQQSPEEGKVEPEKLKTLTEGLEAYSRVRKRNRKSGKLNNHLEAAIHEAMSELDKMSGTVHQIPQGDRQMRPPKPKRRKISR

SEQ ID NO: 53380 - protein, 725 aa, Homo sapiens
MAAASAVSVLLVAAERNRWHRLPSLLLPPRTWVWRQRTMKYTTATGRNITKVLIANRGEIACRVMRTAKKLGVQTVAVYSEADRNSMHVDMADEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 53381 - protein, 575 aa, Homo sapiens
MEKIIQVAKTSAAQHIQSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNNVAIAVTYNHDGSYSMQIEDKTFQVLGNLYSEGDCTYLKCSVNGVASKAKLIILENTIYLFSKEGSIEIDIPVPKYLSSVSSQETQGGPLAPMTGTIEKVFVKAGDKVKAGDSLMVMIAMKMEHTIKSPKDGTVKKVFYREGAQANRHTPLVEFEEEESDKRESE

SEQ ID NO: 53382 - protein, 474 aa, Homo sapiens
MAAASAVSVLLVAAERNRWHRLPSLLLPPRTWVWRQRTMKYTTATDEAYSIGPAPSQQSYLSMEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNLTSYSTCLATQSLKLGTCTLISSLNTTNSCCSVGRLQPKSLYARQPWVSSSRRKP

SEQ ID NO: 53383 - protein, 426 aa, Homo sapiens
MEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKLGEAAVRAAKAVNYVGAGTVEFIMDSKHNFCFMEMNTRLQVEHPVTEMITGTDLVEWQLRIAAGEKIPLSQEEITLQGHAFEARIYAEDPSNNFMPVAGPLVHLSTPRADPSTRIETGVRQGDEVSVHYDPMIAKLVVWAADRQAALTKLRYSLRQYNIVGLHTNIDFLLNLSGHPEFEAGNVHTDFIPQHHKQLLLSRKAAAKESLCQAALGLILKEKAMTDTFTLQAHDQFSPFSSSSGRRLNISYTRNMTLKDGKNN

SEQ ID NO: 53384 - protein, 200 aa, Homo sapiens
MEKIIQVAKTSAAQAIHPGCGFLSENMEFAELCKQEGIIFIGPPPSAIRDMGIKSTSKSIMAAAGVPVVEGYHGEDQSDQCLKEHARRIGYPVMIKAVRGGGGKGMRIVRSEQEFQEQLESARREAKKSFNDDAMLIEKFVDTPRHVEVQVFGDHHGNAVYLFERDCSVQRRHQKIIEEAPAPGIKSEVRKKGRSCSQSC

SEQ ID NO: 53385 - protein, 525 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 53386 - protein, 563 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEVSAEDLGGADLHCRKSGVSDHWALDDHHALHLTRKVVRNLNYQKKLDVTIEPSEEPLFPADELYGIVGANLKRSFDVREVIARIVDGSRFTEFKAFYGDTLVTGFARIFGYPVGIVGNNGVLFSESAKKGTHFVQLCCQRNIPLLFLQNITGFMVGREYEAEGIAKDGAKMVAAVACAQVPKITLIIGGSYGAGNYGMCGRAYSPRFLYIWPNARISVMGGEQAANVLATITKDQRAREGKQFSSADEAALKEPIIKKFEEEGNPYYSSARVWDDGIIDPADTRLVLGLSFSAALNAPIEKTDFGIFRM

SEQ ID NO: 53387 - protein, 289 aa, Homo sapiens
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 53388 - protein, 223 aa, Homo sapiens
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAERFHHFAQDLSNS

SEQ ID NO: 53389 - protein, 253 aa, Homo sapiens
MAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEA

SEQ ID NO: 53390 - protein, 347 aa, Homo sapiens
MTVPVRGFSLLRGRLGRAPALGRSTAPSVRAPGEPGSAFRGFRSSGVRHEAIIISGTEMAKHIQKEIQRGVESWVSLGNRRPHLSIILVGDNPASHTYVRNKIRAASAVGICSELILKPKDVSQEELLDVTDQLNMDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAGIPKLITSDMVKEGAAVIDVGINYVHDPVTGKTKLVGDVDFEAVKKKAGFITPVPGGVGPMTVAMLLKNTLLAAKKIIY

SEQ ID NO: 53391 - protein, 146 aa, Homo sapiens
MDPRVSGILVQLPLPDHVDERTICNGIAPEKDVDGFHIINIGRLCLDQHSLIPATASAVWEIIKRTGIQTFGKNVVVAGRSKNVGMPIAMLLHTDGEHERPGGDATVTIAHRYTPKEQLKIHTQLADIIIVAAERFHHFAQDLSNS

SEQ ID NO: 53392 - protein, 418 aa, Homo sapiens
MPMLLPHPHQHFLKGLLRAPFRCYHFIFHSSTHLGSGIPCAQPFNSLGLHCTKWMLLSDGLKRKLCVQTTLKDHTEGLSDKEQRFVDKLYTGLIQGQRACLAEAITLVESTHSRKKELAQVLLQKVLLYHREQEQSNKGKPLAFRVGLSGPPGAGKSTFIEYFGKMLTERGHKLSVLAVDPSSCTSGGSLLGDKTRMTELSRDMNAYIRPSPTRGTLGGVTRTTNEAILLCEGAGYDIILIETVGVGQSEFAVADMVDMFVLLLPPAGGDELQGIKRGIIEMADLVAVTKSDGDLIVPARRIQAEYVSALKLLRKRSQVWKPKVIRISARSGEGISEMWDKMKDFQDLMLASGELTAKRRKQQKVWMWNLIQESVLEHFRTHPTVREQIPLLEQKVLIGALSPGLAADFLLKAFKSRD

SEQ ID NO: 53393 - protein, 424 aa, Homo sapiens
MPMLLPHPHQHFLKGLLRAPFRCYHFIFHSSTHLGSGIPCAQPFNSLGLHCTKWMLLSDGLKRKLCVQTTLKDHTEGLSDKEQRFVDKLYTGLIQGQRACLAEAITLVESTHSRKKELAQVLLQKVLLYHREQEQSNKGKPLAFRVGLSGPPGAGKSTFIEYFGKMLTERGHKLSVLAVDPSSCTSGGSLLGDKTRMTELSRDMNAYIRPSPTRGTLGGVTRTTNEAILLCEGAGYDIILIETVGVGQSEFAVADMVDMFVLLLPPAGGDELQGIKRGIIEMADLVAVTKSDGDLIVPARRIQAEYVSALKLLRKRSQVWKPKVIRISARSGEGISEMWDKMKDFQDLMLASGELTAKRRKQQKVWMWNLIQESVLEHFRTHPTVREQIPLLEQKVLIGALSPGLAADFLLKALKAETNKIHPV

SEQ ID NO: 53394 - protein, 137 aa, Homo sapiens
MADLVAVTKSDGDLIVPARRIQAEYVSALKLLRKRSQVWKPKVIRISARSGEGISEMWDKMKDFQDLMLASGELTAKRRKQQKVWMWNLIQESVLEHFRTHPTVREQIPLLEQKVLIGALSPGLAADFLLKAFKSRD

SEQ ID NO: 53395 - protein, 159 aa, Homo sapiens
MAGLTRFALELVTEKGHTFAEELQKIQCTLQDVGSALATPCSSAREAHLKYTTFKAGPILELEQWIDKYTSQLPPLTAFILPSGGKISSALHFCRAVCRRAERRVVPLVQMGETDANVAKFLNRLSDYLFTLARYAAMKEGNQEKIYMKNDPSAESEGL

SEQ ID NO: 53396 - protein, 250 aa, Homo sapiens
MAVCGLGSRLGLGSRLGLRGCFGAARLLYPRFQSRGPQGVEDGDRPQPSSKTPRIPKIYTKTGDKGFSSTFTGERRPKDDQVFEAVGTTDELSSAIGFALELVTEKGHTFAEELQKIQCTLQDVGSALATPCSSAREAHLKYTTFKAGPILELEQWIDKYTSQLPPLTAFILPSGGKISSALHFCRAVCRRAERRVVPLVQMGETDANVAKFLNRLSDYLFTLARYAAMKEGNQEKIYMKNDPSAESEGL

SEQ ID NO: 53397 - protein, 282 aa, Homo sapiens
MEPKVAELKQKIEDTLCPFGFEVYPFQVAWYNELLPPAFHLPLPGPTLAFLVLSTPAMFDRALKPFLQSCHLRMLTDPVDQCVAYHLGRVRESLPELQIEIIADYEVHPNRRPKILAQTAAHVAGAAYYYQRQDVEADPWGNQRISGVCIHPRFGGWFAIRGVVLLPGIEVPDLPPRKPHDCVPTRADRIALLEGFNFHWRDWTYRDAVTPQERYSEEQKAYFSTPPAQRLALLGLAQPSEKPSSPSPDLPFTTPAPKKPGNPSRARSWLSPRVSPPASPGP

SEQ ID NO: 53398 - protein, 296 aa, Homo sapiens
MANVLCNRARLVSYLPGFCSLVKRVVNPKAFSTAGSSGSDESHVAAAPPDICSRTVWPDETMGPFGPQDQRFQLPGNIGFDCHLNGTASQKKSLVHKTLPDVLAEPLSSERHEFVMAQYVNEFQGNDAPVEQEINSAETYFESARVECAIQTCPELLRKDFESLFPEVANGKLMILTVTQKTKNDMTVWSEEVEIEREVLLEKFINGAKEICYALRAEGYWADFIDPSSGLAFFGPYTNNTLFETDERYRHLGFSVDDLGCCKVIRHSLWGTHVVVGSIFTNATPDSHIMKKLSGN

SEQ ID NO: 53399 - protein, 296 aa, Homo sapiens; identical to SEQ ID NO: 53398

SEQ ID NO: 53400 - protein, 176 aa, Homo sapiens
MARVLKAAAANAVGLFSRLQAPIPTVRASSTSQPLDQVTGSVWNLGRLNHVAIAVPDLEKAAAFYKNILGAQVSEAVPLPEHGVSVVFVNLGNTKMELLHPLGRDSPIAGFLQKNKAGGMHHICIEVDNINAAVMDLKKKKIRSLSEEVKIGAHGKPVIFLHPKDCGGVLVELEQA

SEQ ID NO: 53401 - protein, 689 aa, Homo sapiens
MIEMAAEKEPFLVPAPPPPLKDESGGGGGPTVPPHQEAASGELRGGTERGPGRCAPSAGSPAAAVGRESPGAAATSSSGPQAQQHRGGGPQAQSHGEARLSDPPGRAAPPDVGEERRGGGGTELGPPAPPRPRNGYQPHRPPGGGGGKRRNSCNVGGGGGGFKHPAFKRRRRVNSDCDSVLPSNFLLGGNIFDPLNLNSLLDEEVSRTLNAETPKSSPLPAKGRDPVEILIPKDITDPLSLNTCTDEGHVVLASPLKTGRKRHRHRGQHHQQQQAAGGSESHPVPPTAPLTPLLHGEGASQQPRHRGQNRDAPQPYELNTAINCRDEVVSPLPSALQGPSGSLSAPPAASVISAPPSSSSRHRKRRRTSSKSEAGARGGGQGSKEKGRGSWGGRHHHHHPLPAAGFKKQQRKFQYGNYCKYYGYRNPSCEDGRLRVLKPEWFRGRDVLDLGCNVGHLTLSIACKWGPSRMVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 53402 - protein, 220 aa, Homo sapiens
MVGLDIDSRLIHSARQNIRHYLSEELRLPPQTLEGDPGAEGEEGTTTVRKRSCFPASLTASRGPIAAPQVPLDGADTSVFPNNVVFVTGNYVLDRDDLVEAQTPEYDVVLCLSLTKWVHLNWGDEGLKRMFRRIYRHLRPGGILVLEPQPWSSYGKRKTLTETIYKNYYRIQLKPEQFSSYLTSPDVGFSSYELVATPHNTSKGFQRPVYLFHKARSPSH

SEQ ID NO: 53403 - protein, 283 aa, Homo sapiens
MASGTTTTAVKIGIIGGTGLDDPEILEGRTEKYVDTPFGKPSDALILGKIKNVDCVLLARHGRQHTIMPSKVNYQANIWALKEEGCTHVIVTTACGSLREEIQPGDIVIIDQFIDRTTMRPQSFYDGSHSCARGVCHIPMAEPFCPKTREVLIETAKKLGLRCHSKGTMVTIEGPRFSSRAESFMFRTWGADVINMTTVPEVVLAKEAGICYASIAMATDYDCWKEHEEAVSVDRVLKTLKENANKAKSLLLTTIPQIGSTEWSETLHNLKNMAQFSVLLPRH

SEQ ID NO: 53404 - protein, 155 aa, Homo sapiens
MAAETRNVAGAEAPPPQKRYYRQRAHSNPMADHTLRYPVKPEEMDWSELYPEFFAPLTQNQSHDDPKDKKEKRAQAQVEFADIGCGYGGLLADKDVLPLPRPTFQADKAQVANHQSHPASRICLRAKSWGAGVYHNRCAGATRLDVHSFRRAPTV

SEQ ID NO: 53405 - protein, 276 aa, Homo sapiens
MAAETRNVAGAEAPPPQKRYYRQRAHSNPMADHTLRYPVKPEEMDWSELYPEFFAPLTQNQSHDDPKDKKEKRAQAQVEFADIGCGYGGLLVELSPLFPDTLILGLEIRVKVSDYVQDRIRALRAAPAGGFQNIACLRSNAMKHLPNFFYKGQLTKMFFLFPDPHFKRTKHKWRIISPTLLAEYAYVLRVGGLVYTITDVLELHDWMCTHFEEHPLFERVPLEDLSEDPVVGHLGTSTEEGKKVLRNGGKNFPAIFRRIQDPVLQAVTSQTSLPGH

SEQ ID NO: 53406 - protein, 757 aa, Homo sapiens
MAEVGRTGISYPGALLPQGFWAAVEVWLERPQVANKRLCGARLEARWSAALPCAEARGPGTSAGSEQKERGPGPGQGSPGGGPGPRSLSGPEQGTACCELEEAQGQCQQEEAQREAASVPLRDSGHPGHAEGREGDFPAADLDSLWEDFSQSLARGNSELLAFLTSSGAGSQPEAQRELDVVLRTVIPKTSPHCPLTTPRREIVVQDVLNGTITFLPLEEDDEGNLKVKMSNVYQIQLSHSKEEWFISVLIFCPERWHSDGIVYPKPTWLGEELLAKLAKWSVENKKSDFKSTLSLISIMKYSKAYQELKEKYKEMVKVWPEVTDPEKFVYEDVAIAAYLLILWEEERAERRLTARQSFVDLGCGNGLLVHILSSEGHPGRGIDVRRRKIWDMYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGESLSLAEVANELDTETLRRLKRECGGLQTLLRNSHQVFQVVNGRVHIRDWREETLWKTKQPEAKQRLLSEACKTRLCWFFMHHPDGCALSTDCCPFAHGPAELRPPRTTPRKKIS

SEQ ID NO: 53407 - protein, 411 aa, Homo sapiens
MCIKFSSVIAKKNERWHSDGIVYPKPTWLGEELLAKLAKWSVENKKSDFKSTLSLISIMKYSKAYQELKEKYKEMVKVWPEVTDPEKFVYEDVAIAAYLLILWEEERAERRLTARQSFVDLGCGNGLLVHILSSEGHPGRGIDVRRRKIWDMYGPQTQLEEDAITPNDKTLFPDVDWLIGNHSDELTPWIPVIAARSSYNCRFFVLPCCFFDFIGRYSRRQSKKTQYREYLDFIKEVGFTCGFHVDEDCLRIPSTKRVCLVGKSRTYPSSREASVDEKRTQYIKSRRGCPVSPPGWELSPSPRWVAAGSAGHCDGQQALDARVGCVTRAWAAEHGAGPQAEGPWLPGFHPREKAERVRNCAALPRDFIDQVVLQVANLLLGGKQLNTRSSRNGSLKTWNGGGKLSTILGRG

SEQ ID NO: 53408 - protein, 580 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEKKGPGEVAGTVTGQKRRAEQDSTTVAAFASSLVSGLNSSASEPAKEPAKKSRKHAASDVDLEIESLLNQQSTKEQQSKKVSQEILELLNTTTAKEQSIVEKFRSRGRAQVQEFCDYGTKEECMKASDADRPCRKLHFRRIINKHTDESLGDCSFLNTCFHMDTCKYVHYEIDACMDSEAPGSKDHTPSQELALTQSVGGDSSADRLFPPQWICCDIRYLDVSILGKFAVVMADPPWDIHMELPYGTLTDDEMRRLNIPVLQDDGFLFLWVTGRAMELGRECLNLWGYERVDEIIWVKTNQLQRIIRTGRTGHWLNHGKEHCLVGVKGNPQGFNQGLDCDVIVAEVRSTSHKPDEIYGMIERLSPGTRKIELFGRPHNVQPNWITLGNQLDGIHLLDPDVVARFKQRYPDGIISKPKNL

SEQ ID NO: 53409 - protein, 163 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEVKRGLLQDDAHPTLVTYADHSKLSAMMGAVAEK

SEQ ID NO: 53410 - protein, 153 aa, Homo sapiens
MSDTWSSIQAHKKQLDSLRERLQRRRKQDSGHLDLRNPEAALSPTFRSDSPVPTAPTSGGPKPSTASAVPELATDPELEKKLLHHLSDLALTLPTDAVSICLAISTPDAPATQDGVESLLQKFAAQELIEHRNQQRSQPRNQGNMLPQMLIWR

SEQ ID NO: 53411 - protein, 396 aa, Homo sapiens
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 53412 - protein, 344 aa, Homo sapiens
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRWTKEDLELINKWAFQGERMIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 53413 - protein, 171 aa, Homo sapiens
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDG

SEQ ID NO: 53414 - protein, 344 aa, Homo sapiens; identical to SEQ ID NO: 53412

SEQ ID NO: 53415 - protein, 202 aa, Homo sapiens
MIHGNPSGVDNAVSTWGGALRYHQGKISSLKRSPALQILLTNTKVPRNTRALVAGVRNRLLKFPEIVAPLLTSIDAISLECERVLGEMGEAPAPEQYLVLEELIDMNQHHLNALGVGHASLDQLCQVTRARGLHSKLTGAGGGGCGITLLKPGLEQPEVEATKQALTSCGFDCLETSIGAPGVSIHSATSLDSRVQQALDGL

SEQ ID NO: 53416 - protein, 201 aa, Homo sapiens
MLSEVLLVSAPGKVILHGEHAVVHGKVALAVSLNLRTFLRLQPHSNGKVDLSLPNIGIKRAWDVARLQSLDTSFLEQGDVTTPTSEQVEKLKEVAGLPDDCAVTERLAVLAFLYLYLSICRKQRALPSLDIVVWSELPPGAGLGSSAAYSVCLAAALLTVCEEIPNPLKDGDCVNRWTKEDLELINKWAFQGERMIHGNPS

SEQ ID NO: 53417 - protein, 520 aa, Homo sapiens
MPSLVVSGIMERNGGFGELGCFGGSAKDRGLLEDERALQLALDQLCLLGLGEPPAPTAGEDGGGGGGGAPAQPAAPPQPAPPPPPAAPPAAPTAAPAAQTPQPPTAPKGASDAKLCALYKEAELRLKGSSNTTECVPVPTSEHVAEIVGRQGCKIKALRAKTNTYIKTPVRGEEPVFMVTGRREDVATARREIISAAEHFSMIRASRNKSGAAFGVAPALPGQVTIRVRVPYRVVGLVVGPKGATIKRIQQQTNTYIITPSRDRDPVFEITGAPGNVERAREEIETHIAVRTGKILEYNNENDFLAGSPDAAIDSRYSDAWRVHQPGCKPLSTFRQNSLGCIGECGVDSGFEAPRLGEQGGDFGYGGYLFPGYGVGKQDVYYGVAETSPPLWAGQENATPTSVLFSSASSSSSSSAKARAGPPGAHRSPATSAGPELAGLPRRPPGEPLQGFSKLGGGGLRSPGGGRDCMVCFESEVTAALVPCGHNLFCMECAVRICERTDPECPVCHITATQAIRIFS

SEQ ID NO: 53418 - protein, 569 aa, Homo sapiens
MPSSLFADLERNGSGGGGGGSSGGGETLDDQRALQLALDQLSLLGLDSDEGASLYDSEPRKKSVNMTECVPVPSSEHVAEIVGRQGCKIKALRAKTNTYIKTPVRGEEPVFVVTGRKEDVAMARREIISAAEHFSMIRASRNKNTALNGAVPGPPNLPGQTTIQVRVPYRVVGLVVGPKGATIKRIQQQTHTYIVTPSRDKEPVFEVTGMPENVDRAREEIEAHIALRTGGIIELTDENDFHANGTDVGFDLHHGSGGSGPGSLWSKPTPSITPTPGRKPFSSYRNDSSSSLGSASTDSYFGGGTSSSAAATQRLADYSPPSPALSFAHNGNNNNNGNGYTYTAGGEASVPSPDGCPELQPTFDPAPAPPPGAPLIWAQFERSPGGGPAAPVSSSCSSSASSSASSSSVVFPGGGASAPSNANLGLLVHRRLHPGTSCPRLSPPLHMAPGAGEHHLARRVRSDPGGGGLAYAAYANGLGAQLPGLQPSDTSGSSSSSSSSSSSSSSSSGLRRKGSRDCSVCFESEVIAALVPCGHNLFCMECANRICEKSEPECPVCHTAVTQAIRIFS

SEQ ID NO: 53419 - protein, 659 aa, Homo sapiens
MPSGSSAALALAAAPAPLPQPPPPPPPPPPPLPPPSGGPELEGDGLLLRERLAALGLDDPSPAEPGAPALRAPAAAAQGQARRAAELSPEERAPPGRPGAPEAAELELEEDEEEGEEAELDGDLLEEEELEEAEEEDRSSLLLLSPPAATASQTQQIPGGSLGSVLLPAARFDAREAAAAAAAAGVLYGGDDAQGMMAAMLSHAYGPGGCGAAAAALNGEQAALLRRKSVNTTECVPVPSSEHVAEIVGRQGCKIKALRAKTNTYIKTPVRGEEPIFVVTGRKEDVAMAKREILSAAEHFSMIRASRNKNGPALGGLSCSPNLPGQTTVQVRVPYRVVGLVVGPKGATIKRIQQQTHTYIVTPSRDKEPVFEVTGMPENVDRAREEIEMHIAMRTGNYIELNEENDFHYNGTDVSFEGGTLGSAWLSSNPVPPSRARMISNYRNDSSSSLGSGSTDSYFGSNRLADFSPTSPFSTGNFWFGDTLPSVGSEDLAVDSPAFDSLPTSAQTIWTPFEPVNPLSGFGSDPSGNMKTQRRGSQPSTPRLSPTFPESIEHPLARRVRSDPPSTGNHVGLPIYIPAFSNGTNSYSSSNGGSTSSSPPESRRKHDCVICFENEVIAALVPCGHNLFCMECANKICEKRTPSCPVCQTAVTQAIQIHS

SEQ ID NO: 53420 - protein, 165 aa, Homo sapiens
WRWTSCRRSGWGALATRTRRGRPGTPPPPRPSPPDVFAGFAPHPAALGPPTLLADQMSVIGSRKKSVNMTECVPVPSSEHVAEIVGRQGCKIKALRAKTNTYIKTPVRGEEPVFIVTGRKEDVEMAKREILSAAEHFSIIRATRSKAGGLPGAAQGPPNLPGQTT

SEQ ID NO: 53421 - protein, 666 aa, Homo sapiens
MPSSLGQPDGGGGGGGGGGGVGAAGEDPGPGPAPPPEGAQEAAPAPRPPPEPDDAAAALRLALDQLSALGLGGAGDTDEEGAAGDGAAAAGGADGGAAPEPVPPDGPEAGAPPTLAPAVAPGSLPLLDPNASPPPPPPPRPSPPDVFAGFAPHPAALGPPTLLADQMSVIGSRKKSVNMTECVPVPSSEHVAEIVGRQGCKIKALRAKTNTYIKTPVRGEEPVFIVTGRKEDVEMAKREILSAAEHFSIIRATRSKAGGLPGAAQGPPNLPGQTTIQVRVPYRVVGLVVGPKGATIKRIQQRTHTYIVTPGRDKEPVFAVTGMPENVDRAREEIEAHITLRTGAFTDAGPDSDFHANGTDVCLDLLGAAASLWAKTPNQGRRPPTATAGLRGDTALGAPSAPEAFYAGSRGGPSVPDPGPASPYSGSGNGGFAFGAEGPGAPVGTAAPDDCDFGFDFDFLALDLTVPAAATIWAPFERAAPLPAFSGCSTVNGAPGPPAAGARRSSGAGTPRHSPTLPEPGGLRLELPLSRRGAPDPVGALSWRPPQGPVSFPGGAAFSTATSLPSSPAAAACAPLDSGASENSRKPPSASSAPALARECVVCAEGEVMAALVPCGHNLFCMDCAVRICGKSEPECPACRTPATQAIRVETETPQPGGASALQRQY

SEQ ID NO: 53422 - protein, 651 aa, Homo sapiens
MPSSLGQPDGGGGGGGGGGGVGAAGEDPGPGPAPPPEGAQEAAPAPRPPPEPDDAAAALRLALDQLSALGLGGAGDTDEEGAAGDGAAAAGGADGGAAPEPVPPDGPEAGAPPTLAPAVAPGSLPLLDPNASPPPPPPPRPSPPDVFAGFAPHPAALGPPTLLADQMSVIGSRKKSVNMTECVPVPSSEHVAEIVGRQGCKIKALRAKTNTYIKTPVRGEEPVFIVTGRKEDVEMAKREILSAAEHFSIIRATRSKAGGLPGAAQGPPNLPGQTTIQVRVPYRVVGLVVGPKGATIKRIQQRTHTYIVTPGRDKEPVFAVTGMPENVDRAREEIEAHITLRTGAFTDAGPDSDFHANGTDVCLDLLGAAASLWAKTPNQGRRPPTATAGLRGDTALGAPSAPEAFYAGSRGGPSVPDPGPASPYSGSGNGGFAFGAEGPGAPVGTAAPDDCDFGFDFDFLALDLTVPAAATIWAPFERAAPLPAFSGCSTVNGAPGPPAAGARRSSGAGTPRHSPTLPEPGGLRLELPLSRRGAPDPVGALSWRPPQGPVSFPGGAAFSTATSLPSSPAAAACAPLDSGASENSRKPPSASSAPALARECVVCAEGEVMAALVPCGHNLFCMDCAVRICGKSEPECPACRTPATQAIHIFS

SEQ ID NO: 53423 - protein, 321 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 53424 - protein, 307 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQVTRSHLVVTNCSAEHSHPALSCKMAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFHSHLETLQLLRTAQLPEQVTLSYGVFEGKLNVIKLQGPFSPEEDPSRFRSLHCLLYPDTPWCPQLGAR

SEQ ID NO: 53425 - protein, 118 aa, Homo sapiens
MQCRLPRGLAGALLTLLCMGLLCLRYHLNLSPQRVQGTPELSQPNPGPPKLQLHDVFIAVKTTRAFHRLRLELLLDTWVSRTREQTFVFTDSPDKGLQERLGSPDSSSLLQGPTLWSP

SEQ ID NO: 53426 - protein, 132 aa, Homo sapiens
MAAEFDTFLASGLRWFCHVDDDNYVNPRALLQLLRAFPLARDVYVGRPSLNRPIHASEPQPHNRTRLVQFWFATGGAGFCINRKLALKMAPWASGSRFMDTSALIRLPDDCTMGYIIECKLGGRLQPSPLFH

SEQ ID NO: 53427 - protein, 43 aa, Homo sapiens
MAAEFDTFLASGLRWFCHVDDDNYVNPRALLQLLRAFPLARDV

SEQ ID NO: 53428 - protein, 87 aa, Homo sapiens
  MOD_RES (1)..(1): Any amino acid
XSHLETLQLLRTAQLPEQISLPPLSALSRYTLVSPAGCPMNPELLGKGWAETSGCALAPKVALWVPGKCLVIGSPWQGLRVVGKPRI

SEQ ID NO: 53429 - protein, 332 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNLETEEWTVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 53430 - protein, 194 aa, Homo sapiens
MGQRDQGLDRERKGPQDDPGSYQGPERRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 53431 - protein, 289 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPQSSRAQTLAMNVRNFLKEDAMKTKTHYHAMHADCLQELRRYLESGVVLRRTVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 53432 - protein, 245 aa, Homo sapiens
MGQRDQRLDRERKGPQDDPGSYQGPERRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 53433 - protein, 383 aa, Homo sapiens
MGLGPVFLLLAGIFPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEGLHSLQEIRVCEIHEDNSTRSSQHFYYDGELFLSQNLETKEWTMPQSSRAQTLAMNVRNFLKEDAMKTKTHYHAMHADCLQELRRYLKSGVVLRRTVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 53434 - protein, 289 aa, Homo sapiens; identical to SEQ ID NO: 53431

SEQ ID NO: 53435 - protein, 332 aa, Homo sapiens; identical to SEQ ID NO: 53429

SEQ ID NO: 53436 - protein, 194 aa, Homo sapiens; identical to SEQ ID NO: 53430

SEQ ID NO: 53437 - protein, 276 aa, Homo sapiens
FPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 53438 - protein, 385 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNVETEEWTVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 53439 - protein, 247 aa, Homo sapiens
MGQRDQGLDRERKGPQDDPGSYQGPERRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 53440 - protein, 223 aa, Homo sapiens
FPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPPMVNVTRSEASEGNITVTCRASSFYPRNIILTWRQDGVSLSHDTQQWGDVLPDGNGTYQTWVATRICRGEEQRFTCYMEHSGNHSTHPVPSGKVLVLQSHWQTFHVSAVAAGCCYFCYYYFLCPLL

SEQ ID NO: 53441 - protein, 223 aa, Homo sapiens; identical to SEQ ID NO: 53440

SEQ ID NO: 53442 - protein, 223 aa, Homo sapiens; identical to SEQ ID NO: 53440

SEQ ID NO: 53443 - protein, 332 aa, Homo sapiens; identical to SEQ ID NO: 53429

SEQ ID NO: 53444 - protein, 342 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAAAAAAIFVIIIFYVRCCKKKTSAAEGPELVSLQVLDQHPVGTSDHRDATQLGFQPLMSALGSTGSTEGA

SEQ ID NO: 53445 - protein, 274 aa, Homo sapiens
FPFAPPGAAAEPHSLRYNLTVLSWDGSVQSGFLTEVHLDGQPFLRCDRQKCRAKPQGQWAEDVLGNKTWDRETRDLTGNGKDLRMTLAHIKDQKEVPPMVNVTRSEASEGNITVTCRASGFYPWNITLSWRQDGVSLSHDTQQWGDVLPDGNGTYQTWVATRICQGEEQRFTCYMEHSGNHSTHPVPSGKVLVLQSHWQTFHVSAVAAAAIFVIIIFYVRCCKKKTSAAEGPELVSLQVLDQHPVGTSDHRDATQLGFQPLMSDLGSTGSTEGA

SEQ ID NO: 53446 - protein, 194 aa, Homo sapiens; identical to SEQ ID NO: 53430

SEQ ID NO: 53447 - protein, 289 aa, Homo sapiens; identical to SEQ ID NO: 53431

SEQ ID NO: 53448 - protein, 332 aa, Homo sapiens; identical to SEQ ID NO: 53429

SEQ ID NO: 53449 - protein, 332 aa, Homo sapiens; identical to SEQ ID NO: 53429

SEQ ID NO: 53450 - protein, 383 aa, Homo sapiens; identical to SEQ ID NO: 53433

SEQ ID NO: 53451 - protein, 332 aa, Homo sapiens; identical to SEQ ID NO: 53429

SEQ ID NO: 53452 - protein, 332 aa, Homo sapiens
MGLGPVFLLLAGIFPFAPPGAAAEPHSLRYNLTVLSWDGSVQSGFLAEVHLDGQPFLRYDRQKCRAKPQGQWAEDVLGNKTWDRETRDLTGNGKDLRMTLAHIKDQKEGLHSLQEIRVCEIHEDNSTRSSQHFYYDGELFLSQNVETEEWTVPQSSRAQTLAMNVRNFLKEDAMKTKTHYHAMHADCLQELRRYLESSVVLRRRVPPMVNVTRSEASEGNITVTCRASSFYPRNITLTWRQDGVSLSHDTQQWGDVLPDGNGTYQTWVATRICQGEEQRFTCYMEHSGNHSTHPVPSGKVLVLQSHWQTFHVSAVAACCCYFCYYYFLCPLL

SEQ ID NO: 53453 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAENVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 53454 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 53455 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAENVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 53456 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53457 - protein, 41 aa, Homo sapiens
MGLGRVLLFLAVAFPFAPPAAAAVEMGFHRVSQDGLDLLTS

SEQ ID NO: 53458 - protein, 360 aa, Homo sapiens
  MOD_RES (1)..(1): Any amino acid
XPHSLRYNLMVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53459 - protein, 383 aa, Homo sapiens [sequence omitted]

SEQ ID NO: 53460 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53461 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53462 - protein, 340 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 53463 - protein, 340 aa, Homo sapiens; identical to SEQ ID NO: 53460

SEQ ID NO: 53464 - protein, 340 aa, Homo sapiens; identical to SEQ ID NO: 53455

SEQ ID NO: 53465 - protein, 383 aa, Homo sapiens [sequence omitted]

SEQ ID NO: 53466 - protein, 383 aa, Homo sapiens; identical to SEQ ID NO: 53453

SEQ ID NO: 53467 - protein, 340 aa, Homo sapiens; identical to SEQ ID NO: 53456

SEQ ID NO: 53468 - protein, 317 aa, Homo sapiens
  MOD_RES (1)..(1): Any amino acid
XPHSLRYNLMVLSQDGSVQSGFLAEGHLDGQPFLRYDRQKRRAKPQGQWAEDVLGAKTWDTETEDLTENGQDLRRTLTHIKDQKGVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53469 - protein, 383 aa, Homo sapiens
MGLGRVLLFLAVAFPFAPPAAAAEPHSLRYNLMVLSQDGSVQSGFLAEGHLDGQPFLRYDRQKRRAKPQGQWAEDVLGAETWDTETEDLTENGQDLRRTLTHIKDQKGGLHSLQEIRVCEMHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53470 - protein, 351 aa, Homo sapiens
MVLSQDGSVQSGFLAEGHLDGQPFLRYDRQKRRAKPQGQWAENVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 53471 - protein, 41 aa, Homo sapiens; identical to SEQ ID NO: 53457

SEQ ID NO: 53472 - protein, 41 aa, Homo sapiens; identical to SEQ ID NO: 53457

SEQ ID NO: 53473 - protein, 351 aa, Homo sapiens
MVLSQDGSVQSGFLAEGHLDGQPFLRYDRQKRRAKPQGQWAEDVLGAETWDTETEDLTENGQDLRRTLTHIKDQKGGLHSLQEIRVCEMHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53474 - protein, 351 aa, Homo sapiens
MVLSQDGSVQSGFLAEGHLDGQPFLRYDRQKRRAKPQGQWAEDVLGAKTWDTETEDLTENGQDLRRTLTHIKDQKGGLHSLQEIRVCEIHEDSSTRGSRHFYYDGELFLSQNLETQESTVPQSSRAQTLAMNVTNFWKEDAMKTKTHYRAMQADCLQKLQRYLKSGVAIRRTVPPMVNVICSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGT

SEQ ID NO: 53475 - protein, 41 aa, Homo sapiens; identical to SEQ ID NO: 53457

SEQ ID NO: 53476 - protein, 41 aa, Homo sapiens; identical to SEQ ID NO: 53457

SEQ ID NO: 53477 - protein, 351 aa, Homo sapiens; identical to SEQ ID NO: 53470

SEQ ID NO: 53478 - protein, 41 aa, Homo sapiens; identical to SEQ ID NO: 53457

SEQ ID NO: 53479 - protein, 41 aa, Homo sapiens; identical to SEQ ID NO: 53457

SEQ ID NO: 53480 - protein, 351 aa, Homo sapiens
MVLSQDGSVQSGFLAEGHLDGQPFLRYDRQKRRAKPQGQWAEDVLGAETWDTETEDLTENGQDLRRTLTHIKDQKGGLHSLQEIRVCEIHEDSSTRGSRHFYYNGELFLSQNLETQESTVPQSSRAQTLAMNVTNFWKEDAMKTKTHYRAMQADCLQKLQRYLKSGVAIRRTVPPMVNVTCSEVSEGNITVTCRASSFYPRNITLTWRQDGVSLSHNTQQWGDVLPDGNGTYQTWVATRIRQGEEQRFTCYMEHSGNHGTHPVPSGKALVLQSQRTDFPYVSAAMPCFVIIIILCVPCCKKKTSAAEGPELVSLQVLDQHPVGTGDHRDAAQLGFQPLMSATGSTGSTEGA

SEQ ID NO: 53481 - protein, 695 aa, Homo sapiens
MSPPKDPSPSLPLPSSSSHSSSPPSSSSTSVSGNAPDGSSPPQMTASEPLSQVSRGHPSPPTPNFRRRAVAQGAPREIPLYLPHHPKPEWAEYCLVSPGEDGLSDPAEMTSDECQPAEAPLGDIGSNHRDPHPIWGKDRSWTGQELSPLAGEDREKGSTGARKEEEGGPVLVKEKLGLKKLVLTQEQKTMLLDWNDSIPESVHLKAGERISQKSAENGRGGRVLKPVRPLLLPRAAGEPLPTQRGAQEKMGTPAEQAQGERNVPPPKSPLRLIANAIRRSLEPLLSNSEGGKKAWAKQESKTLPAQACTRSFSLRKTNSNKDGDQHSPGRNQSSAFSPPDPALRTHSLPNRPSKVFPALRSPPCSKIEDVPTLLEKVSLQENFPDASKPPKKRISLFSSLRLKDKSFESFLQESRQRKDIRDLFGSPKRKVLPEDSAQALEKLLQPFKSTSLRQAAPPPPPPPPPPPPPPTAGGADSKNFPLRAQVTEASSSASSTSSSSADEEFDPQLSLQLKEKKTLRRRKKLEKAMKQLVKQEELKRLYKAQAIQRQLEEVEERQRASEIQGVRLEKALRGEADSGTQDEAQLLQEWFKLVLEKNKLMRYESELLIMAQELELEDHQSRLEQKLREKMLKEESQKDEKDLNEEQEVFTELMQVIEQRDKLVDSLEEQRIREKAEDQHFESFVFSRGCQLSRT

SEQ ID NO: 53482 - protein, 29 aa, Homo sapiens
MSPPKDPSPSLPLPSSSSHSSSPPSSSST

SEQ ID NO: 53483 - protein, 173 aa, Homo sapiens
MSLLGPKVLLFLAAFIITSDWIPLGVNSQRGDDVTQATPETFTEDPNLVNDPATDETVLAVLADIAPSTDDLASLSEKNTTAECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 53484 - protein, 163 aa, Homo sapiens
MSLLGPKVLLFLAAFIITSDWIPLGVNSQRGDDVTQATPETFTEDPNLVNDPATDETVLAVLADIAPSTDDLECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 53485 - protein, 148 aa, Homo sapiens
MSLLGPKVLLFLAAFIITSDWIPLGVNSQRGDDVTQATPETFTEDPNLVNDPATDETECWDEKFTCTRLYSVHRPVKQCIHQLCFTSLRRMYIVNKEICSRLVCKEHEAMKDELCRQMAGLPPRRLRRSNYFRLPPCENVDLQRPNGL

SEQ ID NO: 53486 - protein, 163 aa, Homo sapiens; identical to SEQ ID NO: 53484

SEQ ID NO: 53487 - protein, 91 aa, Homo sapiens
MSLLGPKVLLFLAAFIITSDWIPLGVNSQRGDDVTQATPETFTEDPNLVNDPATDETVLAVLADIAPSTDDLASLSEKNTTAECWDEKFTC

SEQ ID NO: 53488 - protein, 439 aa, Homo sapiens
MSVPSALMKQPPIQSTAGAVPVRNEKGEISMEKVKVKRYVSGKRPDYAPMESSDEEDEEFQFIKKAKEQEAEPEEQEEDSSSDPRLRRLQNRISEDVEERLARHRKIVEPEVVGESDSEVEGDAWRMEREDSSEEEEEEIDDEEIERRRGMMRQRAQERKNEEMEVMEVEDEGRSGEESESESEYEEYTDSEDEMEPRLKPVFIRKKDRVTVQEREAEALKQKELEQEAKRMAEERRKYTLKIVEEETKKELEENKRSLAALDALNTDDENDEEEYEAWKVRELKRIKRDREDREALEKEKAEIERMRNLTEEERRAELRANGKVITNKAVKGKYKFLQKYYHRGAFFMDEDEEVYKRDFSAPTLEDHFNKTILPKVMQVKNFGRSGRTKYTHLVDQDTTSFDSAWGQESAQNTKFFKQKAAGVRDVFERPSAKKRKTT

SEQ ID NO: 53489 - protein, 182 aa, Homo sapiens
MRAAYLFLLFLPGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 53490 - protein, 183 aa, Homo sapiens
MRAAYLFLLFLPAGLLAQGQYDLDPLPPFPDHVQYTHYSDQIDNPDYYDYQEVTPRPSEEQFQFQSQQQVQQEVIPAPTPEPGNAELEPTEPGPLDCREEQYPCTRLYSIHRPCKQCLNEVCFYSLRRVYVINKEICVRTVCAHEELLRADLCRDKFSKCGVMASSGLCQSVAASCARSCGSC

SEQ ID NO: 53491 - protein, 182 aa, Homo sapiens; identical to SEQ ID NO: 53489

SEQ ID NO: 53492 - protein, 362 aa, Homo sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 53493 - protein, 362 aa, Homo sapiens; identical to SEQ ID NO: 53492

SEQ ID NO: 53494 - protein, 216 aa, Homo sapiens
MSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEMFEAVRVDDPDDLGERIKERPALNAQGGIYVINPEMGRSNSPGGDSDDGSLNEQGQEIAVQVSVHLQSETKSIDTESQGSSHFSPPDDIGSAESNCNYKDGAYENCQL

SEQ ID NO: 53495 - protein, 17 aa, Homo sapiens
MKLHCCLFTLVASIIVP

SEQ ID NO: 53496 - protein, 109 aa, Homo sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFL

SEQ ID NO: 53497 - protein, 123 aa, Homo sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYT

SEQ ID NO: 53498 - protein, 255 aa, Homo sapiens
MKALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 53499 - protein, 279 aa, Homo sapiens
MGELSPLQRPLATEGTMKAQGVLLKLALLALPLLLLLSTPPCAPQVSGIRGDALERFCLQQPLDCDDIYAQGYQSDGVYLIYPSGPSVPVPVFCDMTTEGGKWTVFQKRFNGSVSFFRGWNDYKLGFGRADGEYWLGLQNMHLLTLKQKYELRVDLEDFENNTAYAKYADFSISPNAVSAEEDGYTLFVAGFEDGGAGDSLSYHSGQKFSTFDRDQDLFVQNCAALSSGAFWFRSCHFANLNGFYLGGSHLSYANGINWAQWKGFYYSLKRTEMKIRRA

SEQ ID NO: 53500 - protein, 155 aa, Homo sapiens
MVDLTQVMDDEVFMAFASYATIILSKMMLMSTATAFYRLTRKVFANPEDCVAFGKGENAKKYLRTDDRVERVRRAHLNDLENIIPFLGIGLLYSLSGPDPSTAILHFRLFVGARIYHTIAYLTPLPQPNRALSFFVGYGVTLSMAYRLLKSKLYL

SEQ ID NO: 53501 - protein, 155 aa, Homo sapiens; identical to SEQ ID NO: 53500

SEQ ID NO: 53502 - protein, 155 aa, Homo sapiens; identical to SEQ ID NO: 53500

SEQ ID NO: 53503 - protein, 155 aa, Homo sapiens; identical to SEQ ID NO: 53500

SEQ ID NO: 53504 - protein, 77 aa, Homo sapiens
MVDLTQVMDDEVFMAFASYATIILSKMMLMSTATAFYRLTRKVFANPEDCVAFGKGENAKKYLRTDDRVERVRRAHL

SEQ ID NO: 53505 - protein, 42 aa, Homo sapiens
MVDLTQVMDDEVFMAFASYATIILSKMMLMSTATAFYRLTRK

SEQ ID NO: 53506 - protein, 80 aa, Homo sapiens
MVDLTQVMDDEVFMAFASYATIILSKMMLMSTATAFYRLTRKVFANPEDCVAFGKGENAKKYLRTDDRVERVRRAHLNDL

SEQ ID NO: 53507 - protein, 87 aa, Homo sapiens
MVDLTQVMDDEVFMAFASYATIILSKMMLMSTATAFYRLTRKVFANPEDCVAFGKGENAKKYLRTDDRVERVRRIKQTLSIYLASSI

SEQ ID NO: 53508 - protein, 147 aa, Homo sapiens
MAGNSILLAAVSILSACQQSYFALQVGKARLKYKVTPPAVTGSPEFERVFRAQQNCVEFYPIFIITLWMAGWYFNQVFATCLGLVYIYGRHLYFWGYSEAAKKRITGFRLSLGILALLTLLGALGIANSFLDEYLDLNIAKKLRRQF

SEQ ID NO: 53509 - protein, 147 aa, Homo sapiens; identical to SEQ ID NO: 53508

SEQ ID NO: 53510 - protein, 77 aa, Homo sapiens
MAGNSILLAAVSILSACQQSYFALQVGKARLKYKVTPPAVTGSPEFERVFRAHFCYLSGSGVHIWPSPILLGIFRSC

SEQ ID NO: 53511 - protein, 166 aa, Homo sapiens
MPWRGRRFRLCRRKMAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 53512 - protein, 152 aa, Homo sapiens
MAVLSKEYGFVLLTGAASFIMVAHLAINVSKARKKYKVEYPIMYSTDPENGHIFNCIQRAHQNTLEVYPPFLFFLAVGGVYHPRIASGLGLAWIVGRVLYAYGYYTGEPSKRSRGALGSIALLGLVGTTVCSAFQHLGWVKSGLGSGPKCCH

SEQ ID NO: 53513 - protein, 166 aa, Homo sapiens; identical to SEQ ID NO: 53511

SEQ ID NO: 53514 - protein, 166 aa, Homo sapiens; identical to SEQ ID NO: 53511

SEQ ID NO: 53515 - protein, 152 aa, Homo sapiens; identical to SEQ ID NO: 53512

SEQ ID NO: 53516 - protein, 166 aa, Homo sapiens; identical to SEQ ID NO: 53511

SEQ ID NO: 53517 - protein, 323 aa, Homo sapiens
MPRLTFAPKGWPHPPTSLHWWLFQELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 53518 - protein, 981 aa, Homo sapiens
MASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKAEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 53519 - protein, 1067 aa, Homo sapiens [sequence omitted]

SEQ ID NO: 53520 - protein, 1086 aa, Homo sapiens
MSCLSHSSLPSCCPPQEASMASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANFVNGRTVEETQVPEISGVARIYNQSFFQSLLKATGIDLENIVYYKDDTHYFVMTAKKQCLLRLGVLRQDWPDTNRLLGSANVVPEALQRFTRAAADFATHGKLGKLEFAQDAHGQPDVSAFDFTSMMRAESSARVQEKHGARLLLGLVGDCLVEPFWPLGTGVARGFLAAFDAAWMVKRWAEGAESLEVLAERESLYQLLSQTSPENMHRNVAQYGLDPATRYPNLNLRAVTPNQVRDLYDVLAKEPVQRNNDKTDTGMPATGSAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKAEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 53521 - protein, 591 aa, Homo sapiens
PKYVLPSEAQVVPAKQLQPQDRSSVPEHSLLAGTQEELLRWCQEQTAGYPGVHVSDLSSSWADGLALCALVYRLQPGLLEPSELQGLGALEATAWALKVAENELGITPVVSAQAVVAGSDPLGLIAYLSHFHSAFKSMAHSPGPVSQASPGTSSAVLFLSKLQRTLQRSRAKENAEDAGGKKLRLEMEAETPSTEVPPDPEPGVPLTPPSQHQEAGAGDLCALCGEHLYVLERLCVNGHFFHRSCFRCHTCEATLWPGGYEQHPGDGHFYCLQHLPQTDHKAEGSDRGPESPELPTPSENSMPPGLSTPTASQEGAGPVPDPSQPTRRQIRLSSPERQRLSSLNLTPDPEMEPPPKPPRSCSALARHALESSFVGWGLPVQSPQALVAMEKEEKESPFSSEEEEEDVPLDSDVEQALQTFAKTSGTMNNYPTWRRTLLRRAKEEEMKRFCKAQTIQRRLNEIEAALRELEAEGVKLELALRRQSSSPEQQKKLWVGQLLQLVDKKNSLVAEEAELMITVQELNLEEKQWQLDQELRGYMNREENLKTAADRQAEDQVLRKLVDLVNQRDALIRFQEERRLSELALGTGAQG

SEQ ID NO: 53522 - protein, 244 aa, Homo sapiens
MASPTSTNPAHAHFESFLQAQLCQDVLSSFQELCGALGLEPGGGLPQYHKIKDQLNYWSAKSLWTKLDKRAGQPVYQQGRACTSTKCLVVGAGPCGLRVAVELALLGARVVLVEKRTKFSRHNVLHLWPFTIHDLRALGAKKFYGRFCTGTLDHISIRQLQLLLLKVALLLGVEIHWGVTFTGLQPPPRKGSGWRAQLQPNPPAQLANYEFDVLISAAGGKFVPEGFKVREMRGKLAIGITANF

SEQ ID NO: 53523 - protein, 1124 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 53524 - protein, 1103 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQERRVSGIGKPVLCSSSGPPVHSCCPKPEEATPSPSPPLKRQFPSVVVTGHVLRELKQVSAGSECLSRPWRARAKSDLQLGGTENFATLPSTRPRAQALSGVLWRLQQVEEKILQKRAQNLANREFHTKNIKEKAAHLASMFGHGDFPQNKLLSKGLSHTHPPSPPSRLPSPDPAASSSPSTVDSASPARKLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 53525 - protein, 976 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQEKKSPSGFHFHPSHLRTVHPQESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 53526 - protein, 120 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDS

SEQ ID NO: 53527 - protein, 134 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTI

SEQ ID NO: 53528 - protein, 88 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTK

SEQ ID NO: 53529 - protein, 3 aa, Homo sapiens
MGE

SEQ ID NO: 53530 - protein, 98 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCG

SEQ ID NO: 53531 - protein, 88 aa, Homo sapiens; identical to SEQ ID NO: 53528

SEQ ID NO: 53532 - protein, 102 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTA

SEQ ID NO: 53533 - protein, 934 aa, Homo sapiens
MGENEDEKQAQAGQVFENFVQASTCKGTLQAFNILTRHLDLDPLDHRNFYSKLKSKVTTWKAKALWYKLDKRGSHKEYKRGKSCTNTKCLIVGGGPCGLRTAIELAYLGAKVVVVEKRDSFSRNNVLHLWPFTIHDLRGLGAKKFYGKFCAGSIDHISIRQLQLILFKVALMLGVEIHVNVEFVKVLEPPEDQENQKIGWRAEFLPTDHSLSEFEFDVIIGADGRRNTLEGFRRKEFRGKLAIAITANFINRNSTAEAKVEEISGVAFIFNQKFFQDLKEETGIDLENIVYYKDCTHYFVMTAKKQSLLDKGVIINDYIDTEMLLCAENVNQDNLLSYAREAADFATNYQLPSLDFAMNHYGQPDVAMFDFTCMYASENAALVRERQAHQLLVALVGDSLLEPFWPMGTGCARGFLAAFDTAWMVKSWNQGTPPLELLAERESLYRLLPQTTPENINKNFEQYTLDPGTRYPNLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPVHFSLPVLHPLLG

SEQ ID NO: 53534 - protein, 545 aa, Homo sapiens
MRSSPDLNSHCVRPHQVKHLYITKELEHYPLERLGSVRRSVNLSRKESDIRPSKLLTWCQQQTEGYQHVNVTDLTTSWRSGLALCAIIHRFRPELINFDSLNEDDAVENNQLAFDVAEREFGIPPVTTGKEMASAQEPDKLSMVMYLSKFYELFRGTPLRPVDSWRKNYGENADLSLAKSSISNNYLNLTFPRKRTPRVDGQTGENDMNKRRRKGFTNLDEPSNFSSRSLGSNQECGSSKEGGNQNKVKSMANQLLAKFEESTRNPSLMKQEKKSPSGFHFHPSHLRTVHPQLTVGKVSSGIGAAAEVLVNLYMNDHRPKAQATSPDLESMRKSFPLNLGGSDTCYFCKKRVYVMERLSAEGHFFHRECFRCSICATTLRLAAYTFDCDEGKFYCKPHFIHCKTNSKQRKRRAELKQQREEEATWQEQEAPRRDTPTESSCAVAAIGTLEGSPPGISTSFFRKVLGWPLRLPRDLCNWMQGLLQAAGLHIRDNAYNYCYMYELLSLGLPLLWAFSEVLAAMYRESEGSLESICNWVLRCFPVKLR

SEQ ID NO: 53535 - protein, 976 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQLTQERGASQPSCCLPGQVRPAPTPRWKQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 53536 - protein, 948 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRSARRAAGRPPATRP

SEQ ID NO: 53537 - protein, 966 aa, Homo sapiens
MEERKHETMNPAHVLFDRFVQATTCKGTLKAFQELCDHLELKPKDYRSFYHKLKSKLNYWKAKALWAKLDKRGSHKDYKKGKACTNTKCLIIGAGPCGLRTAIDLSLLGAKVVVIEKRDAFSRNNVLHLWPFTIHDLRGLGAKKFYGKFCAGAIDHISIRQLQLILLKVALILGIEIHVNVEFQGLIQPPEDQENERIGWRALVHPKTHPVSEYEFEVIIGGDGRRNTLEGFRRKEFRGKLAIAITANFINRNTTAEAKVEEISGVAFIFNQKFFQELREATGIDLENIVYYKDDTHYFVMTAKKQSLLDKGVILHDYADTELLLSRENVDQEALLSYAREAADFSTQQQLPSLDFAINHYGQPDVAMFDFTCMYASENAALVREQNGHQLLVALVGDSLLEPFWPMGTGIARGFLAAMDSAWMVRSWSLGTSPLEVLAERESIYRLLPQTTPENVSKNFSQYSIDPVTRYPNINVNFLRPSQVRHLYDTGETKDIHLEMESLVNSRTTPKLTRNESVARSSKLLGWCQRQTDGYAGVNVTDLTMSWKSGLALCAIIHRYRPDLIDFDSLDEQNVEKNNQLAFDIAEKELGISPIMTGKEMASVGEPDKLSMVMYLTQFYEMFKDSLPSSDTLDLNAEEKAVLIASTRSPISFLSKLGQTISRKRSPKDKKEKDLDGAGKRRKTSQSEEEEAPRGHRGERPTLVSTLTDRRMDVAVGNQNKVKYMATQLLAKFEENAPAQSIGIRRQGSMKKEFPQNLGGSDTCYFCQKRVYVMERLSAEGKFFHRSCFKCEYCATTLRLSAYAYDIEDGKFYCKPHYCYRLSGYAQRKRPAVAPLSGKEAKGPLQDGATTDANGRANAVASSTERTPGSGVNGLEEPSIAKRLRGTPERIELENYRLSLRQAEALQEVPEETQAEHNLSSVLDTGAEEDVASRDWVSPWLPRMVSNSWAQMIHPPQPPTVLGSQM

SEQ ID NO: 53538 - protein, 1570 aa, Homo sapiens
MSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSSMEQLSQHEPKTPVAAAGSSKREPSTKGPEEKVAGKREGLGGLTLREKTWRGGSPEIKRFSASEASFLEGEASPPLGARRRFSALLEPSRFSAPQEDEDEARLRRPPRPSSDPAGSLDARAPKEETQGEGTSSAGDSEATDRPRPGDLCPPSKDGDASGPRATNDLVLRRARHQQMSGDVAVEKRPSRTGGKVIKSASATALSVMIPAVDPHGSSPLASPMSPRSLSSNPSSRDSSPSRDYSPAVSGLRSPITIQRSGKKYGFTLRAIRVYMGDTDVYSVHHIVWHVEEGGPAQEAGLCAGDLITHVNGEPVHGMVHPEVVELILKSGNKVAVTTTPFENTSIRIGPARRSSYKAKMARRNKRPSAKEGQESKKRSSLFRKITKQSNLLHTSRSLSSLNRSLSSSDSLPGSPTHGLPARSPTHSYRSTPDSAYLGASSQSSSPASSTPNSPASSASHHIRPSTLHGLSPKLHRQYRSARCKSAGNIPLSPLAHTPSPTQASPPPLPGHTVGSSHTTQSFPAKLHSSPPVVRPRPKSAEPPRSPLLKRVQSAEKLGASLSADKKGALRKHSLEVGHPDFRKDFHGELALHSLAESDGETPPVEGLGAPRQVAVRRLGRQESPLSLGADPLLPEGASRPPVSSKEKESPGGAEACTPPRATTPGGRTLERDVGCTRHQSVQTEDGTGGMARAVAKAALSPVQEHETGRRSSSGEAGTPLVPIVVEPARPGAKAVVPQPLGADSKGLQEPAPLAPSVPEAPRGRERWVLEVVEERTTLSGPRSKPASPKLSPEPQTPSLAPAKCSAPSSAVTPVPPASLLGSGTKPQVGLTSRCPAEAVPPAGLTKKGVSSPAPPGP

SEQ ID NO: 53539 - protein, 725 aa, Homo sapiens
MSDSLWTALSNFSMPSFPGGSMFRRTKSCRTSNRKSLILTSTSPTLPRPHSPLPGHLGSSPLDSPRNFSPNTPAHFSFASSRRADGRRWSLASLPSSGYGTNTPSSTVSSSCSSQERLHQLPYQPTVDELHFLSKHFGSTESITDEDGGRRSPAVRPRSRSLSPGRSPSSYDNEIVMMNHVYKERFPKATAQMEEKLRDFTRAYEPDSVLPLADGVLSFIHHQIIELARDCLTKSRDGLITTVYFYELQENLEKLLQDAYERSESLEVAFVTQLVKKLLIIISRPARLLECLEFNPEEFYHLLEAAEGHAKEGHLVKTDIPRYIIRQLGLTRDPFPDVVHLEEQDSGGSNTPEQDDLSEGRSSKAKKPPGENDFDTIKLISNGAYGAVYLVRHRDTRQRFAMKKINKQNLILRNQIQQAFVERDILTFAENPFVVGMFCSFETRRHLCMVMEYVEGGDCATLLKNIGALPVEMARMYFAETVLALEYLHNYGIVHRDLKPDNLLITSMGHIKLTDFGLSKMGLMSLTTNLYEGHIEKDAREFLDKQVCGTPEYIAPEVILRQGYGKPVDWWAMGIILYEFLVGCVPFFGDTPEELFGQVISDDILWPEGDEALPTEAQLLISSLLQTNPLVRLGAGGAFEVKQHSFFRDLDWTGLLRQKAEFIPHLESEDDTSYFDTRSDRYHHVNSYDEDDTTEEEPVEIRQFSSCSPRFSKVYSLRIHMYTYK

SEQ ID NO: 53540 - protein, 1798 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPSRDFLPALGSMRPPIIIHRAGKKYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSVGGNSSQSSSPSSSVPSSPAGSGHTRPSSLHGLAPKLQRQYRSPRRKSAGSIPLSPLAHTPSPPPPTASPQRSPSPLSGHVAQAFPTKLHLSPPLGRQLSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 53541 - protein, 792 aa, Homo sapiens
MFSPTSAPALFLTKVPFSADCALATSPLAIFLNPRAHSSPGTPCSSRPLPWSCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEHHPSA

SEQ ID NO: 53542 - protein, 1608 aa, Homo sapiens
MKRSRCRDRPQPPPPDRREDGVQRAAELSQSLPPRRRAPPGRQRLEERTGPAGPEGKEQDVVTGVSPLLFRKLSNPDIFSSTGKVKLQRQLSQDDCKLWRGNLASSLSGKQLLPLSSSVHSSVGQVTWQSSGEASNLVRMRNQSLGQSAPSLTAGLKELSLPRRGSFCRTSNRKSLIVTSSTSPTLPRPHSPLHGHTGNSPLDSPRNFSPNAPAHFSFVPARRTDGRRWSLASLPSSGYGTNTPSSTVSSSCSSQEKLHQLPFQPTADELHFLTKHFSTESVPDEEGRQSPAMRPRSRSLSPGRSPVSFDSEIIMMNHVYKERFPKAHERSESSEVAFVMQLVKKLMIIIARPARLLECLEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSHTESDSSPPMTVRRRCSGLLDAPRFPEGPEEASSTLRRQPQEGIWVLTPPSGEGVSGPVTEHSGEQRPKLDEEAVGRSSGSSPAMETRGRGTSQLAEGATAKAISDLAVRRARHRLLSGDSTEKRTARPVNKVIKSASATALSLLIPSEHHTCSPLASPMSPHSQSSNPSSRDSSPYGFTLRAIRVYMGDSDVYTVHHMVWHVEDGGPASEAGLRQGDLITHVNGEPVHGLVHTEVVELILKSGNKVAISTTPLENTSIKVGPARKGSYKAKMARRSKRSRGKDGQESRKRSSLFRKITKQASLLHTSRSLSSLNRSLSSGESGPGSPTHSHSLSPRSPTQGYRVTPDAVHSELSRPKSAEPPRSPLLKRVQSAEKLAAALAASEKKLATSRKHSLDLPHSELKKELPPREVSPLEVVGARSVLSGKGALPGKGVLQPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLTPTSSCSPPSSTSGKLSMWSWKSLIEGPDRASPSRKATMAGGLANLQDLENTTPAQPKNLSPREQGKTQPPSAPRLAHPSYEDPSQGWLWESECAQAVKEDPALSITQVPDASGDRRQDVPCRGCPLTQKSEPSLRRGQEPGGHQKHRDLALVPDELLKQT

SEQ ID NO: 53543 - protein, 630 aa, Homo sapiens
MRPRSRSLSPGRSPVSFDSEIIMMNHVYKERFPKATAQMEERLAEFISSNTPDSVLPLADGALSFIHHQVIEMARDCLDKSRSGLITSQYFYELQDNLEKLLQDEFDPEEFYHLLEAAEGHAKEGQGIKCDIPRYIVSQLGLTRDPLEEMAQLSSCDSPDTPETDDSIEGHGASLPSKKTPSEEDFETIKLISNGAYGAVFLVRHKSTRQRFAMKKINKQNLILRNQIQQAFVERDILTFAENPFVVSMFCSFDTKRHLCMVMEYVEGGDCATLLKNIGALPVDMVRLYFAETVLALEYLHNYGIVHRDLKPDNLLITSMGHIKLTDFGLSKIGLMSLTTNLYEGHIEKDAREFLDKQVCGTPEYIAPEVILRQGYGKPVDWWAMGIILYEFLVGCVPFFGDTPEELFGQVISDEIVWPEGDEALPPDAQDLTSKLLHQNPLERLGTGSAYEVKQHPFFTGLDWTGLLRQKAEFIPQLESEDDTSYFDTRSERYHHMDSEDEEEVSEDGCLEIRQFSSCSPRFNKVYSSMERLSLLEERRTPPPTKRSLSEEKEDHSDGLAGLKGRDRSWVIGSPEILRKRLSVSESSLLKVAGRPSTFSQHFGTHPHQQLLSSQLHLWEAEHVVLEIPY

SEQ ID NO: 53544 - protein, 344 aa, Homo sapiens
MDDSSILRRRGLQKELSLPRRGSFCRTSNRKSLIVTSSTSPTLPRPHSPLHGHTGNSPLDSPRNFSPNAPAHFSFVPARSHSHRADRTDGRRWSLASLPSSGYGTNTPSSTVSSSCSSQEKLHQLPFQPTADELHFLTKHFSTESVPDEEGRQSPAMRPAPSRALGTLRQDRAERRESLQKQEAIREVDSSEDDTEEGPENSQGAQELSLAPHPEVSQSVAPKGAGESGEEDPFPSRDPRSLGPMVPSLLTGITLGPPRMESPSGPHRRLGSPQAIEEAASSSSAGPNLGQSGATDPIPPEGCWKAQHLHTQALTALSPSTSGLAHLMRIPARAGYGSLSVHKQ

SEQ ID NO: 53545 - protein, 1309 aa, Homo sapiens
MDESSLLRRRGLQKELSLPRRGRGCRSGNRKSLVVGTPSPTLSRPLSPLSVPTAGSSPLDSPRNFSAASALNFPFARRADGRRWSLASLPSSGYGTNTPSSTLSSSSSSRERLHQLPFQPTPDELHFLSKHFRSSENVLDEEGGRSPRLRPRSRSLSPGRATGTFDNEIVMMNHVYRERFPKATAQMEGRLQEFLTAYAPGARLALADGVLGFIHHQIVELARDCLAKSGENLVTSRYFLEMQEKLERLLQDAHERSDSEEVSFIVQLVRKLLIIISRPARLLECLEFDPEEFYHLLEAAEGHAREGQGIKTDLPQYIIGQLGLAKDPLEEMVPLSHLEEEQPPAPESPESRALVGQSRRKPCESDFETIKLISNGAYGAVYLVRHRDTRQRFAIKKINKQNLILRNQIQQVFVERDILTFAENPFVVSMFCSFETRRHLCMVMEYVEGGDCATLLKNMGPLPVDMARLYFAETVLALEYLHNYGIVHRDLKPDNLLITSLGHIKLTDFGLSKIGLMSMATNLYEGHIEKDAREFIDKQVCGTPEYIAPEVIFRQGYGKPVDWWAMGVVLYEFLVGCVPFFGDTPEELFGQVVSDEIMWPEGDEALPADAQDLITRLLRQSPLDRLGTGGTHEVKQHPFFLALDWAGLLRHKAEFVPQLEAEDDTSYFDTRSERYRHLGSEDDETNDEESSTEIPQFSSCSHRFSKVYSSSEFLAVQPTPTFAERSFSEDREEGWERSEVDYGRRLSADIRLRSWTSSGSSCQSSSSQPERGPSPSLLNTISLDTMPKFAFSSEDEGVGPGPAGPKRPVFILGEPDPPPAATPVMPKPSSLSADTAALSHARLRSNSIGARHSTPRPLDAGRGRRLGGPRDPAPEKSRASSSGGSGGGSGGRVPKSASVSALSLIITADDGSGGPLMSPLSPRSLSSNPSSRDSSPSRDPSPVCGSLRPPIVIHSSGKKYGFSLRAIRVYMGDSDVYTVHHVVWSVEDGSPAQEAGLRAGDLITHINGESVLGLVHMDVVELLLKSGNKISLRTTALENTSIKVGPARKNVAKGRMARRSKRSRRRETQDRRKSLFKKISKQTSVLHTSRSFSSGLHHSLSSSESLPGSPTHSLSPSPTTPCRSPAPDVPADTTASPPSASPSSSSPASPAAAGHTRPSSLHGLAAKLGPPRPKTGRRKSTSSIPPSPLACPPISAPPPRSPSPLPGHPPAPARSPRLRRGQSADKLGTGERLDGEAGRRTRGPEAELVVMRRLHLSERRDSFKKQEAVQEVSFDEPQEEATGLPTSVPQIAVEGEEAVPVALGPTGRD

SEQ ID NO: 53546 - protein, 840 aa, Homo sapiens
MDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQTPNQIKSGTPYRTPKSVRRGVAPVDDGRILGTPDYLAPELLLGRAHDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 53547 - protein, 879 aa, Homo sapiens
MDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQQTPNQIKSGTPYRTPKSVRRGVAPVDDGRILGTPDYLAPELLLGRAHGPAVDWWALGVCLFEFLTGIPPFNDETPQQVFQNILKRDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 53548 - protein, 878 aa, Homo sapiens
MDPTAGSKKEPGGGAATEEGVNRIAVPKPPSIEEFSIVKPISRGAFGKVYLGQKGGKLYAVKVVKKADMINKNMTHQVQAERDALALSKSPFIVHLYYSLQSANNVYLVMEYLIGGDVKSLLHIYGYFDEEMAVKYISEVALALDYLHRHGIIHRDLKPDNMLISNEGHIKLTDFGLSKVTLNRDINMMDILTTPSMAKPRQDYSRTPGQVLSLISSLGFNTPIAEKNQDPANILSACLSETSQLSQGLVCPMSVDQKDTTPYSSKLLKSCLETVASNPGMPVKCLTSNLLQSRKRLATSSASSQSHTFISSVESECHSSPKWEKDCQESDEALGPTMMSWNAVEKLCAKSANAIETKGFNKKDLELALSPIHNSSALPTTGRSCVNLAKKCFSGEVSWEAVELDVNNINMDTDTSQLGFHQSNQWAVDSGGISEEHLGKRSLKRNFELVDSSPCKKIIQNKKTCVEYKHNEMTNCYTNQNTGLTVEVQDLKLSVHKSQQNDCANKENIVNSFTDKQQTPEKLPIPMIAKNLMCELDEDCEKNSKRDYLSSSFLCSDDDRASKNISMNSDSSFPGISIMESPLESQPLDSDRSIKESSFEESNIEDPLIVTPDCQEKTSPKGVENPAVQESNQKMLGPPLEVLKTLASKRNAVAFRSFNSHINASNNSEPSRMNMTSLDAMDISCAYSGSYPMAITPTQKRRSCMPHQTPNQIKSGTPYRTPKSVRRGVAPVDDGRILGTPDYLAPELLLGRAHGPAVDWWALGVCLFEFLTGIPPFNDETPQQVFQNILKRDIPWPEGEEKLSDNAQSAVEILLTIDDTKRAGMKELKRHPLFSDVDWENLQHQTMPFIPQPDDETDTSYFEARNTAQHLTVSGFSL

SEQ ID NO: 53549 - protein, 5938 aa, Homo sapiens
MQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFFLGNQFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 53550 - protein, 5430 aa, Homo sapiens
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQVSQFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 53551 - protein, 5430 aa, Homo sapiens
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALEEDIENHATDVHQAVKIGQSLSSLTSPAEQGVLSEKIDSLQARYSEIQDRCCRKAALLDQALSNARLFGEDEVEVLNWLAEVEDKLSSVFVKDFKQDVLHRQHADHLALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 53552 - protein, 1062 aa, Homo sapiens
MGNSLGCFKEPKESIAIPEKAPISPKKRVRFKRRWRGKKIPTPEASHQEETSEGTGVIEETETLTKLTESLQKEDGVGGVEHTPPDILLPGDSAPNSRVVDRGMIVQVKERFQGEVQTAHLLLENESSVAGGVWDSLEEGMTVIAHLLDNPAERNCEKSVSQLVEFPRTASCSSRAVLLPLQGETAVEKGNIQRGFRSCALPRTDYPTDKGNQEQFSEGWSVEEGTKSVSGAPQTASWIIECSVSSLLLDQPGGQRRTEPSHVGQVPPQDSRLPTSQSDLSISGVTVSILPSSSGYGSDGPHIHGIQPKDTEPEKSSTSFSEEDGTLSLEASHTPSWGLEEISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMFQDEKEQLIQSKSSVASLVGRSKTIVQLKPRSPDHVLKNTISVKAVCDYRQIEGRTILSEGYGPLASAAC

SEQ ID NO: 53553 - protein, 7388 aa, Homo sapiens
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKECRAVAGVIDLGTVEIFPIFKAMQKGLLDQDTGLVLLESQVIMSGLIAPETGENLSLEEGIARNLINPQMYQQLRELQDALALISRLTESRGPLSVVEAIEKRIISETVGLKILEAHLATGGFSLSPSENCINLEEAFHQGLISAWLHSVLESYLRTSKNLIDPNTAEKIGLLDLMQRCIVHQESGFKLLPVKQLAGGMVSLKSGRKVSIFRAVQEGLIDRQVTVRLLEAQLFAGGIVDPRTGHRLTVEEAVRHNLIDQDMACAILIRQLQTGGIIDTVTGQRLTIDEAVSNDLVAAKIALVILESLWSFMGLLWPESGEILPITDALEQGIVSTELAHKILSNRQHIKALFLPATTEILSWKKAIESGILDRDLANNLKSICIPDVMPHMQLADSAEQNINPGAAVLPCSKSHPKATASQSENLLFQLMTHSYINVQNGQRLLLLDKELMETLTSRDEYQTSPPKVVEIGHQRQKTPEGLQESANVKISGTFSSGWTVRLPEFQFSSQNKEYPDREDCTTEKGKKTTVETEDSSVENPEQDLFVEQKERNPNIDALKVINKVKLEVQRQLIGTQREDQTAVSVRENASRGHLLTIPPAEAEGVPLVVDKDVFSVETPKKEHQPLRNTSFTCQNEQAHTLETEYIHDETGGSHIKPQSKKLQVQVKKTLGIKLELKSETDGNVHPLDKKEMLKKTFLAKDDHKESQEAQNIAGGSMMMSEKTDEEDSGREIFLSCSHPLELLEEATLNVLSAQLLDGGIFHEQTGQKLLLNEAISRGIVPSHTAVKLMEKLNMFQGFFDSQTCESLTTEEVINEGLMDEKLLHNVLMADKAISGVLDPRTQTLCSVKDAVTVGLLDKETATRILERQVVTGGIIDLKRGKKVSVTLASTLGLVDVADQPELINLEKASKGRDAEKTVRERLISLQMETTGLIDPDSKAPLTVVQSIDRGLLEREEAVRLLTKQVVDGGIIHHISGMRLSVDNAFRHGLIGEDLAEKLKRVENLNIHQIFNPETKENISLPKAIKLDLITSDLKREIQEVQAFTGNFVDLISGQRLTLAEAKKEGLLTNEAVLSPGMMHGIVDPENCRIVPYSELVKKCKIDIESGQRYLEVIPFSDIKDGVSDKVLTLSQAIQLGKVDFASTLKVLEAQANTGGIIDTATGKRLTLASALEEKLVDENMVRIIASHQVLNGGIVDIFSDQRVTLVEAIEKRLISPELANMIQIDSSEFSDHRAQIEKQEGIEVCALQNEFLGKDMLIACNQTAEMSCNKVEESERLFQVENQSAQEKVKVRVSDGEQAKKSREISLKEFGCKDQRKPRMSSDAKEFISIINPHNLKGKSLGQVSLTHPYSECDFKLKEVARNNMGNDTNEEQEKAVTKIEIISHMKQSTSCLDSEEIRENQGEVILEVQETYCETSGKLPSEQVLQQPMNARVKSKREKREVIVEESIRTCKPAFLSEEKLYQETAIRDEHDSHIKSQPREMTSSEKGKEADTEMGFSITFKIEESSSQVVPQGISVKHLDALTLFSSKQANEGKVNNLSLCLTLKPEENLSREIACGAQSEPFPCMTPRPEGLHYQESDGKAQVTGPSQISKTDKSFQGTTRQETNYQDSWVTSKTKETKHQISSSNECKEKSYQEVSFDPARGLKLEEITVSRPDSKEVRYLEFSDRKDLHHQGSKSDDKLCGTLKSEIATQELTGEKFLEMANPNVAGLEAGSIEDIVTQRGSRVLGSFLPEKLFKGVSQKENTGQQNAIISPTVLETSEEKTVSLTVCSAVKTEKTPQEKLRESPGSEQTPFMTAPEGKGNGGVNPEPFRATQNVFTRQLCLEHDEKLVSYLSLLRNIEMRTKQIQPLELNLAELQDLLCQAKVLERELKDLTTLVSQELECVNQIIISQPQEVPAQLLKALEKDAKNLQKSLSSVSDTWNSRLLHFQNAVEIEKTKVLNQHTQLEGRLQDLRAWVGNKNLILNSKGSNSEIDVDSLNLCLQQYEDLKQPMAERKAQLDALAFDIQFFISEHAQDLSPQQNRQMLRLLNELQRSFQDILEQTAAQVDALQGHLQQMEQEALVKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTGSILPSVGSSVGSVNGYHTCKDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQITEFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 53554 - protein, 384 aa, Homo sapiens
ITSPWAPRPSCSSPWAMSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKE

SEQ ID NO: 53555 - protein, 200 aa, Homo sapiens
MPLLDSSYLPPTIFILTHVLGVAGVLYWKRHARGRADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYR

SEQ ID NO: 53556 - protein, 5300 aa, Homo sapiens
MSSSDEETLSERSCRSERSCRSERSYRSERSGSLSPCPPGDTLPWNLPLHEQKKRKSQDSVLDPAERAVVRVADERDRVQKKTFTKWVNKHLMKVRKHINDLYEDLRDGHNLISLLEVLSGIKLPREKGRMRFHRLQNVQIALDFLKQRQVKLVNIRNDDITDGNPKLTLGLIWTIILHFQISDIYISGESGDMSAKEKLLLWTQKVTAGYTGIKCTNFSSCWSDGKMFNALIHRYRPDLVDMERVQIQSNRENLEQAFEVAERLGVTRLLDAEDVDVPSPDEKSVITYVSSIYDAFPKVPEGGEGISATEVDSRWQEYQSRVDSLIPWIKQHTILMSDKTFPQNPVELKALYNQYIHFKETEILAKEREKGRIEELYKLLEVWIEFGRIKLPQGYHPNDVEEEWGKLIIEMLEREKSLRPAVERLELLLQIANKIQNGALNCEEKLTLAKNTLQADAAHLESGQPVQCESDVIMYIQECEGLIRQLQVDLQILRDENYYQLEELAFRVMRLQDELVTLRLECTNLYRKGHFTSLELVPPSTLTTTHLKAEPLTKATHSSSTSWFRKPMTRAELVAISSSEDEGNLRFVYELLSWVEEMQMKLERAEWGNDLPSVELQLETQQHIHTSVEELGSSVKEARLYEGKMSQNFHTSYAETLGKLETQYCKLKETSSFRMRHLQSLHKFVSRATAELIWLNEKEEEELAYDWSDNNSNISAKRNYFSELTMELEEKQDVFRSLQDTAELLSLENHPAKQTVEAYSAAVQSQLQWMKQLCLCVEQHVKENTAYFQFFSDARELESFLRNLQDSIKRKYSCDHNTSLSRLEDLLQDSMDEKEQLIQSKSSVASLVGRSKTIVQLKPRSPDHVLKNTISVKAVCDYRQIEITICKNDECVLEDNSQRTKWKVISPTGNEAMVPSVCFLIPPPNKDAIEMASRVEQSYQKVMALWHQLHVNTKSLISWNYLRKDLDLVQTWNLEKLRSSAPGECHQIMKNLQAHYEDFLQDSRDSVLFSVADRLRLEEEVEACKARFQHLMKSMENEDKEETVAKMYISELKNIRLRLEEYEQRVVKRIQSLASSRTDRDAWQDNALRIAEQEHTQEDLQQLRSDLDAVSMKCDSFLHQSPSSSSVPTLRSELNLLVEKMDHVYGLSTVYLNKLKTVDVIVRSIQDAELLVKGYEIKLSQEEVVLADLSALEAHWSTLRHWLSDVKDKNSVFSVLDEEIAKAKVVAEQMSRLTPERNLDLERYQEKGSQLQERWHRVIAQLEIRQSELESIQEVLGDYRACHGTLIKWIEETTAQQEMMKPGQAEDSRVLSEQLSQQTALFAEIERNQTKLDQCQKFSQQYSTIVKDYELQLMTYKAFVESQQKSPGKRRRMLSSSDAITQEFMDLRTRYTALVTLTTQHVKYISDALRRLEEEEKVVEEEKQEHVEKVKELLGWVSTLARNTQGKATSSETKESTDIEKAILEQQVLSEELTTKKEQVSEAIKTSQIFLAKHGHKLSEKEKKQISEQLNALNKAYHDLCDGSANQLQQLQSQLAHQTEQKTLQKQQNTCHQQLEDLCSWVGQAERALAGHQGRTTQQDLSALQKNQSDLKDLQDDIQNRATSFATVVKDIEGFMEENQTKLSPRELTALREKLHQAKEQYEALQEETRVAQKELEEAVTSALQQETEKSKAAKELAENKKKIDALLDWVTSVGSSGGQLLTNLPGMEQLSGASLEKGALDTTDGYMGVNQAPEKLDKQCEMMKARHQELLSQQQNFILATQSAQAFLDQHGHNLTPEEQQMLQQKLGELKEQYSTSLAQSEAELKQVQTLQDELQKFLQDHKEFESWLERSEKELENMHKGGSSPETLPSLLKRQGSFSEDVISHKGDLRFVTISGQKVLDMENSFKEGKEPSEIGNLVKDKLKDATERYTALHSKCTRLGSHLNMLLGQYHQFQNSADSLQAWMQACEANVEKLLSDTVASDPGVLQEQLATTKQLQEELAEHQVPVEKLQKVARDIMEIEGEPAPDHRHVQETTDSILSHFQSLSYSLAERSSLLQKAIAQSQSVQESLESLLQSIGEVEQNLEGKQVSSLSSGVIQEALATNMKLKQDIARQKSSLEATREMVTRFMETADSTTAAVLQGKLAEVSQRFEQLCLQQQEKESSLKKLLPQAEMFEHLSGKLQQFMENKSRMLASGNQPDQDITHFFQQIQELNLEMEDQQENLDTLEHLVTELSSCGFALDLCQHQDRVQNLRKDFTELQKTVKEREKDASSCQEQLDEFRKLVRTFQKWLKETEGSIPPTETSMSAKELEKQIEHLKSLLDDWASKGTLVEEINCKGTSLENLIMEITAPDSQGKTDLTEIQCDMSDVNLKYEKLGGVLHERQESLQAILNRMEEVHKEANSVLQWLESKEEVLKSMDAMSSPTKTETVKAQAESNKAFLAELEQNSPKIQKVKEALAGLLVTYPNSQEAENWKKIQEELNSRWERATEVTVARQRQLEESASHLACFQAAESQLRPWLMEKELMMGVLGPLSIDPNMLNAQKQQVQFMLKEFEARRQQHEQLNEAAQGILTGPGDVSLSTSQVQKELQSINQKWVELTDKLNSRSSQIDQAIVKSTQYQELLQDLSEKVRAVGQRLSVQSAISTQPEAVKQQLEETSEIRSDLEQLDHEVKEAQTLCDELSVLIGEQYLKDELKKRLETVALPLQGLEDLAADRINRLQAALASTQQFQQMFDELRTWLDDKQSQQAKNCPISAKLERLQSQLQENEEFQKSLNQHSGSYEVIVAEGESLLLSVPPGEEKRTLQNQLVELKNHWEELSKKTADRQSRLKDCMQKAQKYQWHVEDLVPWIEDCKAKMSELRVTLDPVQLESSLLRSKAMLNEVEKRRSLLEILNSAADILINSSEADEDGIRDEKAGINQNMDAVTEELQAKTGSLEEMTQRLREFQESFKNIEKKVEGAKHQLEIFDALGSQACSNKNLEKLRAQQEVLQALEPQVDYLRNFTQGLVEDAPDGSDASQLLHQAEVAQQEFLEVKQRVNSGCVMMENKLEGIGQFHCRVREMFSQLADLDDELDGMGAIGRDTDSLQSQIEDVRLFLNKIHVLKLDIEASEAECRHMLEEEGTLDLLGLKRELEALNKQCGKLTERGKARQEQLELTLGRVEDFYRKLKGLNDATTAAEEAEALQWVVGTEVEIINQQLADFKMFQKEQVDPLQMKLQQVNGLGQGLIQSAGKDCDVQGLEHDMEEINARWNTLNKKVAQRIAQLQEALLHCGKFQDALEPLLSWLADTEELIANQKPPSAEYKVVKAQIQEQKLLQRLLDDRKATVDMLQAEGGRIAQSAELADREKITGQLESLESRWTELLSKAAARQKQLEDILVLAKQFHETAEPISDFLSVTEKKLANSEPVGTQTAKIQQQIIRHKALNEEIVNRKKNVDQAIKNGQALLKQTTGEEVLLIQEKLDGIKTRYADITVTSSKALRTLEQARQLATKFQSTYEELTGWLREVEEELATSGGQSPTGEQIPQFQQRQKELKKEVMEHRLVLDTVNEVSRALLELVPWRAREGLDKLVSDANEQYKLVSDTIGQRVDEIDAAIQRSQQYEQAADAELAWVAETKRKLMALGPIRLEQDQTTAQLQVQKAFSIDIIRHKDSMDELFSHRSEIFGTCGEEQKTVLQEKTESLIQQYEAISLLNSERYARLERAQVLVNQFWETYEELSPWIEETRALIAQLPSPAIDHEQLRQQQEEMRQLRESIAEHKPHIDKLLKIGPQLKELNPEEGEMVEEKYQKAENMYAQIKEEVRQRALALDEAVSQSTQVSQFHDKIEPMLETLENLSSRLRMPPLIPAEVDKIRECISDNKSATVELEKLQPSFEALKRRGEELIGRSQGADKDLAAKEIQDKLDQMVFFWEDIKARAEEREIKFLDVLELAEKFWYDMAALLTTIKDTQDIVHDLESPGIDPSIIKQQVEAAETIKEETDGLHEELEFIRILGADLIFACGETEKPEVRKSIDEMNNAWENLNKTWKERLEKLEDAMQAAVQYQDTLQAMFDWLDNTVIKLCTMPPVGTDLNTVKDQLNEMKEFKVEVYQQQIEMEKLNHQGELMLKKATDETDRDIIREPLTELKHLWENLGEKIAHRQHKLEGALLALGQFQHALEELMSWLTHTEELLDAQRPISGDPKVIEVELAKHHVLKNDVLAHQATVETVNKAGNELLESSAGDDASSLRSRLEAMNQCWESVLQKTEEREQQLQSTLQQAQGFHSEIEDFLLELTRMESQLSASKPTGGLPETAREQLDTHMELYSQLKAKEETYNQLLDKGRLMLLSRDDSGSGSKTEQSVALLEQKWHVVSSKMEERKSKLEEALNLATEFQNSLQEFINWLTLAEQSLNIASPPSLILNTVLSQIEEHKVFANEVNAHRDQIIELDQTGNQLKFLSQKQDVVLIKNLLVSVQSRWEKVVQRSIERGRSLDDARKRAKQFHEAWKKLIDWLEDAESHLDSELEISNDPDKIKLQLSKHKEFQKTLGGKQPVYDTTIRTGRALKEKTLLPEDSQKLDNFLGEVRDKWDTVCGKSVERQHKLEEALLFSGQFMDALQALVDWLYKVEPQLAEDQPVHGDLDLVMNLMDAHKVFQKELGKRTGTVQVLKRSGRELIENSRDDTTWVKGQLQELSTRWDTVCKLSVSKQSRLEQALKQAEVFRDTVHMLLEWLSEAEQTLRFRGALPDDTEALQSLIDTHKEFMKKVEEKRVDVNSAVAMGEVILAVCHPDCITTIKHWITIIRARFEEVLTWAKQHQQRLETALSELVANAELLEELLAWIQWAETTLIQRDQEPIPQNIDRVKALIAEHQTFMEEMTRKQPDVDRVTKTYKRKNIEPTHAPFIEKSRSGGRKSLSQPTPPPMPILSQSEAKNPRINQLSARWQQVWLLALERQRKLNDALDRLEELKEFANFDFDVWRKKYMRWMNHKKSRVMDFFRRIDKDQDGKITRQEFIDGILASKFPTTKLEMTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 53557 - protein, 344 aa, Homo sapiens
MTAVADIFDRDGDGYIDYYEFVAALHPNKDAYRPTTDADKIEDEVTRQVAQCKCAKRFQVEQIGENKYRFGDSQQLRLVRILRSTVMVRVGGGWMALDEFLVKNDPCRARGRTNIELREKFILPEGASQGMTPFRSRGRRSKPSSRAASPTRSSSSASQSNHSCTSMPSSPATPASGTKTSLQFSRCYDKPWLVNSKAGTPIRDSHSPDLQLPTPEVIPSSGSKLKRPTPTFHSSRTSLAGDTSNSSSPASTGAKTNRADPKKSASRPGSRAGSRAGSRASSRRGSDASDFDLLETQSACSDTSESSAAGGQGNSRRGLNKPSKIPTMSKKTTTASPRTPGPKR

SEQ ID NO: 53558 - protein, 5430 aa, Homo sapiens; identical to SEQ ID NO: 53551

SEQ ID NO: 53559 - protein, 2803 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 53560 - protein, 3041 aa, Homo sapiens
METEAEPARPHGVAMETTPGLGLRSPGAPLAQNPAELLCEAGAAVAAARWDLQKHSLLIVIGDIGTESQLRAVRAHLEQGILSWNIDLSSFDLNQQLRLFITRHLAHFSSEVKGQRTLCHQSEILETIILVNPSADSISSEVHHLLSSSSAYKLLILSGQSLEPGGDLILQSGTYSYENFAQVLHNPEISQLLSNRDPGIQAFLTVSCLGEGDWSHLGLSSSQETLHLRLNPEPTLPTMDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVTLIPTHDTEVTREWYQQTHEQQQQLNVLVLASSSTVVMQDESFPACKIEF

SEQ ID NO: 53561 - protein, 2805 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEEKDTWEEKKQREAERLPDRTEAREESEPEVKEDVIEKAELEEMEEVHPSDEEEEDATKAEGFYQKHMQEPLKVTPRSREAFGGRELGLQGKAPEKETSLFLSSLTTPAGATEHVSYIQDETIPGYSETEQTISDEEIHDEPEERPAPPRFHTSTYDLPGPEGAGPFEASQPADSAVPATSGKVYGTPETELTYPTNIVAAPLAEEEHVSSATSITECDKLSSFATSVAEDQSVASLTAPQTEETGKSSLLLDTVTSIPSSRTEATQGLDYVPSAGTISPTSSLEEDKGFKSPPCEDFSVTGESEKRGEIIGKGLSGERAVEEEEEETANVEMSEKLCSQYGTPVFSAPGHALHPGEPALGEAEERCLSPDDSTVKMASPPPSGPPSATHTPFHQSPVEEKSEPQDFQEADSWGDTKRTPGVGKEDAAEETVKPGPEEGTLEKEEKVPPPRSPQAQEAPVNIDEGLTGCTIQLLPAQDKAIVFEIMEAGEPTGPILGAEALPGGLRTLPQEPGKPQKDEVLRYPDRSLSPEDAESLSVLSVPSPDTANQEPTPKSPCGLTEQYLHKDRWPEVSPEDTQSLSLSEESPSKETSLDVSSKQLSPESLGTLQFGELNLGKEEMGHLMQAEDTSHHTAPMSVPEPHAATASPPTDGTTRYSAQTDITDDSLDRKSPASSFSHSTPSGNGKYLPGAITSPDEHILTPDSSFSKSPESLPGPALEDIAIKWEDKVPGLKDRTSEQKKEPEPKDEVLQQKDKTLEHKEVVEPKDTAIYQKDEALHVKNEAVKQQDKALEQKGRDLEQKDTALEQKDKALEPKDKDLEEKDKALEQKDKIPEEKDKALEQKDTALEQKDKALEPKDKDLEQKDRVLEQKEKIPEEKDKALDQKVRSVEHKAPEDTVAEMKDRDLEQTDKAPEQKHQAQEQKDKVSEKKDQALEQKYWALGQKDEALEQNIQALEENHQTQEQESLVQEDKTRKPKMLEEKSPEKVKAMEEKLEALLEKTKALGLEESLVQEGRAREQEEKYWRGQDVVQEWQETSPTREEPAGEQKELAPAWEDTSPEQDNRYWRGREDVALEQDTYWRELSCERKVWFPHELDGQGARPHYTEERESTFLDEGPDDEQEVPLREHATRSPWASDFKDFQESSPQKGLEVERWLAESPVGLPPEEEDKLTRSPFEIISPPASPPEMVGQRVPSAPGQESPIPDPKLMPHMKNEPTTPSWLADIPPWVPKDRPLPPAPLSPAPGPPTPAPESHTPAPFSWGTAEYDSVVAAVQEGAAELEGGPYSPLGKDYRKAEGEREEEGRAEAPDKSSHSSKVPEASKSHATTEPEQTEPEQREPTPYPDERSFQYADIYEQMMLTGLGPACPTREPPLGAAGDWPPCLSTKEAAAGRNTSAEKELSSPISPKSLQSDTPTFSYAALAGPTVPPRPEPGPSMEPSLTPPAVPPRAPILSKGPSPPLNGNILSCSPDRRSPSPKESGRSHWDDSTSDSELEKGAREQPEKEAQSPSPPHPIPMGSPTLWPETEAHVSPPLDSHLGPARPSLDFPASAFGFSSLQPAPPQLPSPAEPRSAPCGSLAFSGDRALALAPGPPTRTRHDEYLEVTKAPSLDSSLPQLPSPSSPGAPLLSNLPRPASPALSEGSSSEATTPVISSVAERFSPSLEAAEQESGELDPGMEPAAHSLWDLTPLSPAPPASLDLALAPAPSLPGDMGDGILPCHLECSEAATEKPSPFQVPSEDCAANGPTETSPNPPGPAPAKAENEEAAACPAWERGAWPEGAERSSRPDTLLSPEQPVCPAGGSGGPPSSASPEVEAGPQGCATEPRPHRGELSPSFLNPPLPPSIDDRDLSTEEVRLVGRGGRRRVGGPGTTGGPCPVTDETPPTSASDSGSSQSDSDVPPETEECPSITAEAALDSDEDGDFLPVDKAGGVSGTHHPRPGHDPPPLPQPDPRPSPPRPDVCMADPEGLSSESGRVERLREKEKVQGRVGRRAPGKAKPASPARRLDLRGKRSPTPGKGPADRASRAPPRPRSTTSQVTPAEEKDGHSPMSKGLVNGLKAGPMALSSKGSSGAPVYVDLAYIPNHCSGKTADLDFFRRVRASYYVVSGNDPANGEPSRAVLDALLEGKAQWGENLQVSVTLIPTHDTEVTREWYQQTHEQQQQLNVLVLASSSTVVMQDESFPACKIEF

SEQ ID NO: 53562 - protein, 627 aa, Homo sapiens
MDGVAEFSEYVSETVDVPSPFDLLEPPTSGGFLKLSKPCCYIFPGGRGDSALFAVNGFNILVDGGSDRKSCFWKLVRHLDRIDSVLLTHIGADNLPGINGLLQRKVAELEEEQSQGSSSYSDWVKNLISPELGVVFFNVPEKLRLPDASRKAKRSIEEACLTLQHLNRLGIQAEPLYRVVSNTIEPLTLFHKMGVGRLDMYVLNPVKDSKEMQFLMQKWAGNSKAKTGIVLPNGKEAEISVPYLTSITALVVWLPANPTEKIVRVLFPGNAPQNKILEGLEKLRHLDFLRYPVATQKDLASGAVPTNLKPSKIKQRADSKESLKATTKTAVSKLAKREEVVEEGAKEARSELAKELAKTEKKAKESSEKPPEKPAKPERVKTESSEALKAEKRKLIKDKVGKKHLKEKISKLEEKKDKEKKEIKKERKELKKDEGRKEEKKDAKKEEKRKDTKPELKKISKPDLKPFTPEVRKTLYKAKVPGRVKIDRSRAIRGEKELSSEPQTPPAQKGTVPLPTISGHRELVLSSPEDLTQDFEEMKREERALLAEQRDTGLGDKPFPLDTAEEGPPSTAIQGTPPSVPGLGQEEHVMKEKELVPEVPEEQGSKDRGLDSGAETEEKKKKKKKKK

SEQ ID NO: 53563 - protein, 559 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSNSTLSKIPALQGSTKSPRYSSACPSTTKRATFSDSLLIQPTSAGSTDRLPYSKSGNKDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVRILNKKIDFSKVQSRCGSKDNIKHSAGGGNVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53564 - protein, 1827 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEDLLTASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53565 - protein, 471 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53566 - protein, 106 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVL

SEQ ID NO: 53567 - protein, 471 aa, Homo sapiens; identical to SEQ ID NO: 53565

SEQ ID NO: 53568 - protein, 1823 aa, Homo sapiens
MADERKDEAKAPHWTSAPLTEASAHSHPPEIKDQGGAGEGLVRSANGFPYREDEEGAFGEHGSQGTYSNTKENGINGELTSADRETAEEVSARIVQVVTAEAVAVLKGEQEKEAQHKDQTAALPLAAEETANLPPSPPPSPASEQTVTVEEASKMEFHDQQELTPSTAEPSDQKEKESEKQSKPGEDLKHAALVSQPETTKTYPDKKDMQGTEEEKAPLALFGHTLVASLEDMKQKTEPSLVVPGIDLPKEPPTPKEQKDWFIEMPTEAKKDEWGLVAPISPGPLTPMREKDVFDDIPKWEGKQFDSPMPSPFQGGSFTLPLDVMKNEIVTETSPFAPAFLQPDDKKSLQQTSGPATAKDSFKIEEPHEAKPDKMAEAPPSEAMTLPKDAHIPVVEEHVMGKVLEEEKEAINQETVQQRDTFTPSGQEPILTEKETELKLEEKTTISDKEAVPKESKPPKPADEEIGIIQTSTEHTFSEQKDQEPTTDMLKQDSFPVSLEQAVTDSAMTSKTLEKAMTEPSALIEKSSIQELFEMRVDDKDKIEGVGAATSAELDMPFYEDKSGMSKYFETSALKEEATKSIEPGSDYYELSDTRESVHESIDTMSPMHKNGDKEFQTGKESQPSPPAQEAGYSTLAQSYPSDLPEEPSSPQERMFTIDPKVYGEKRDLHSKNKDDLTLSRSLGLGGRSAIEQRSMSINLPMSCLDSIALGFNFGRGHDLSPLASDILTNTSGSMDEGDDYLPATTPALEKAPCFPVESKEEEQIEKVKATGEESTQAEISCESPFLAKDFYKNGTVMAPDLPEMLDLAGTRSRLASVSADAEVARRKSVPSETVVEDSRTGLPPVTDENHVIVKTDSQLEDLGYCVFNKYTVPLPSPVQDSENLSGESGTFYEGTDDKVRRDLATDLSLIEVKLAAAGRVKDEFSVDKEASAHISGDKSGLSKEFDQEKKANDRLDTVLEKSEEHADSKEHAKKTEEAGDEIETFGLGVTYEQALAKDLSIPTDASSEKAEKGLSSVPEIAEVEPSKKVEQGLDFAVQGQLDVKISDFGQMASGLNIDDRRATELKLEATQDMTPSSKAPQEADAFMGVESGHMKEGTKVSETEVKEKVAKPDLVHQEAVDKEESYESSGEHESLTMESLKADEGKKETSPESSLIQDEIAVKLSVEIPCPPAVSEADLATDERADVQMEFIQGPKEESKETPDISITPSDVAEPLHETIVSEPAEIQSEEEEIEAQGEYDKLLFRSDTLQITDLGVSGAREEFVETCPSEHKGVIESVVTIEDDFITVVQTTTDEGESGSHSVRFAALEQPEVERRPSPHDEEEFEVEEAAEAQAEPKDGSPEAPASPEREEVALSEYKTETYDDYKDETTIDDSIMDADSLWVDTQDDDRSIMTEQLETIPKEEKAEKEARRSSLEKHRKEKPFKTGRGRISTPERKVAKKEPSTVSRDEVRRKKAVYKKAELAKKTEVQAHSPSRKFILKPAIKYTRPTHLSCVKRKTTAAGGESALAPSVFKQAKDKVSDGVTKSPEKRSSLPRPSSILPPRRGVSGDRDENSFSLNSSISSSARRTTRSEPIRRAGKSGTSTPTTPGSTAITPGTPPSYSSRTPGTPGTPSYPRTPHTPGTPKSAILVPSEKKVAIIRTPPKSPATPKQLRLINQPLPDLKNVKSKIGSTDNIKYQPKGGQVQIVTKKIDLSHVTSKCGSLKNIRHRPGGGRVKIESVKLDFKEKAQAKVGSLDNAHHVPGGGNVKIDSQKLNFREHAKARVDHGAEIITQSPGRSSVASPRRLSNVSSSGSINLLESPQLATLAEDVTAALAKQGL

SEQ ID NO: 53569 - protein, 887 aa, Homo sapiens
METTGDQGIEGMAYMDENRNITFTCPRTPSELINKSSPLEVLESAACEKLPTPTPQVVKEGDSFPDTLAKNGQEIAPAQISKSLMVDNYTKDGVPGQERPKGPSAVVPSTSTGGVALPITTAIETVNIHGDHSLKNKAELADSMKNEAGIDEGHVIGESESVHSGASKHSVEKVTELAKGHLLPGVPVEDQSLPGEARALEGYADRGNFPAHPVNEEKETKEGSVAVQIPDLLEDKAQKLSFCEDQNAQDRNSKGSDSLNKKVDLTLLSPKSENDKLKEISLACKITELESVSLPTPEIQSDFLHSKVEAPPSEVADTLVIMTASKGVRLPEPKDKILETPQKMTEKSESKTPGEGKKEDKSRMAEPMKGYMRPTKSRGLTPLLPKSTIQEQERHKQLKSAGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 53570 - protein, 463 aa, Homo sapiens
ICEEPVAKKREELAHFSNSSSNSGKKELGTAGLYLHSKLEQIPEGSSKEKGQEDFSETRIDSCSQVCQRGEKQPGQTALAGKKEIEVTATQSTPSFLFEKPPRDGIARPEEGRPVVSGTGNDITTPPNKELPPSPEKKTKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 53571 - protein, 1152 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 53572 - protein, 712 aa, Homo sapiens
METTGDQGIEGMAYMDENRNITFTCPRTPSELINKSSPLEVLESAACEKLPTPTPQVVKEGDSFPDTLAKNGQEIAPAQISKSLMVDNYTKDGVPGQERPKGPSAVVPSTSTGGVALPITTAIETVNIHGDHSLKNKAELADSMKNEAGIDEGHVIGESESVHSGASKHSVEKVTELAKGHLLPGVPVEDQSLPGEARALEGYADRGNFPAHPVNEEKETKEGSVAVQIPDLLEDKAQKLSFCEDQNAQDRNSKGSDSLNKKVDLTLLSPKSENDKLKEISLACKITELESVSLPTPEIQSDFLHSKVEAPPSEVADTLVIMTASKGVRLPEPKDKILETPQKMTEKSESKTPGEGKKEDKSRMAEPMKGYMRPTKSRGLTPLLPKSTIQEQERHKQLKSAGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKAKVEKKTEAAATTRKPESNAVTKTAGPIASAQKQPAGKV

SEQ ID NO: 53573 - protein, 811 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDGVRLPEPKDKILETPQKMTEKSESKTPGEGKKEDKSRMAEPMKGYMRPTKSRGLTPLLPKSTIQEQERHKQLKSAGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 53574 - protein, 1135 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 53575 - protein, 828 aa, Homo sapiens
MSLSDKQTASLTAAYGQLSKGKPAECRMDSPKEISQAGFEWQRTEGKLNEIGLNVSMDGQPKDGLVKNASFLEQNKLCFFEGKLDKELSIEMQDKDCQEASGHLESRYVISETCHPLEGNSVHQKTSEFHLGLIEGPDKNKTIPVQGKVAGKNGLETKSQSDLDFPGAADIPTRYVKEQETSVWNPSFHPVAQGSLGSREATPGEMENSITPGCPVIGVVNDNSEQLKCESPLLVSLAHPAPIIEHSPTTIPPITMVFTQEHLNASCHIRDHDKELEKLSSTEEAVLNQAPQQKKAVRRALSECSHLSVPPAVNLADKYPELPAREEPSSGLLPPPSSPMPSPTPGKLGAPAMKRSMTVGEEQTASYKLSPGKLPILSTKEIPPFICEEPVAKKREELAHFSNSSSNSGKKELGTAGLYLHSKLEQIPEGSSKEKGQEDFSETRIDSCSQVCQRGEKQPGQTALAGKKEIEVTATQSTPSFLFEKPPRDGIARPEEGRPVVSGTGNDITTPPNKELPPSPEKKTKPIADAKAPEKRASPSKPASAPASRSGSKSTQTVAKTTTAAAVASTGPSSRSPSTLLPKKPTADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 53576 - protein, 2297 aa, Homo sapiens
MADLSLADALTEPSPDIEGEIKRDFIATLEAEAFDDVVGETVGKTDYIPLLDVDEKTGNSESKKKPCSETSQIEDLPLPPHPASLSFHLPLDTPSSKPTLLANGGHGVEGSDTTGSPTEFLEEKMAYQEYPNSQNWPEDTNFCFQPEQVVDPIQTDPFKMYHDDDLADLVFPSSATADTSIFAGQNDPLKDSYGMSPCNTAVVPQGWSVEALNSPHSESFVSPEAVAEPPQPTAVPLELAKEIEMASEERPPAQALEIMMGLKTTDMAPSKETEMALAKDMALATKTEVALAKDMESPTKLDVTLAKDMQPSMESDMALVKDMELPTEKEVALVKDVRWPTETDVSSAKNVVLPTETEVAPAKDVTLLKETERASPIKMDLAPSKDMGPPKENKKETERASPIKMDLAPSKDMGPPKENKIVPAKDLVLLSEIEVAQANDIISSTEISSAEKVALSSETEVALARDMTLPPETNVILTKDKALPLEAEVAPVKDMAQLPETEIAPAKDVAPSTVKEVGLLKDMSPLSETEMALGKDVTPPPETEVVLIKNVCLPPEMEVALTEDQVPALKTEAPLAKDGVLTLANNVTPAKDVPPLSETEATPVPIKDMEIAQTQKGISEDSHLESLQDVGQSAAPTFMISPETVTGTGKKCSLPAEEDSVLEKLGERKPCNSQPSELSSETSANFMYCGTPPTQAKQVCRPSDRRSTRPKPARVPPELLGGSPPWKTLDHRLGHCSLSESGWVSGSSSCGGPGNQRKSIHVDSLEPQRDLGREAWDIESTPIMMKKKKKKPKQKRYSQPRAGGPSDDDNADKPKGHPFAADTQKSGVLPSQPTTMGTEYGLVSGENLKRECLVNSSAARLVAENFVSESLRIPLYPSEEAPKTAISSQSKLRVEEESKSNKSVLQNQDKKLLKQHEYKPQPAPHLKTPVDKSQSVGPLNLKGPLAEVSAYNVETPLDIRLKEGCSPFLDQEVMGVVSKPTAAKEIPNLVPTLIASNPLECNLKEGNNESKMTKLQNVKLKEFPEGAEEDKELKKEAFPNERQEISIFTSEQLQGQVLVQVPGVENEPFKRMAGDGKSRKGRGSSGKMRTDSGKVKAKSELPFLLDSQKDGRAVLIPSEPVSKTEGMTTQDKSEELGLNSSKQPGTKADLTEAVVMGEPKEMTQPKVAGTMQALIPLESGSGMTQTSGVSTETGDVVKDMGVNNQSKEGRCPWKDHEAAPWISEKPKKRGNEGKSKKFKNNYSTQPARMERKEEILNPPFEGKDGDTGSIPHKSKEIGFTFPKMHDSSFSHTPDTPTVEAVDRKGGNFQVNFVELGTLGENKISTVKASTVTEPPAKVTDVSCQEQIQGAGFVPSVVSEENKTDAANRYTAVADKPSKRSNDGKSKKVKNSSPEKHILENKIDATKIHVPMETTGDQGIEGMAYMDENRNITFTCPRTPSELINKSSPLEVLESAACEKLPTPTPQVVKEGDSFPDTLAKNGQEIAPAQISKSLMVDNYTKDGVPGQERPKGPSAVVPSTSTGGVALPITTAIETVNIHGDHSLKNKAELADSMKNEAGIDEGHVIGESESVHSGASKHSVEKVTELAKGHLLPGVPVEDQSLPGEARALEGYADRGNFPAHPVNEEKETKEGSVAVQIPDLLEDKAQKLSFCEDQNAQDRNSKGSDSLNKKVDLTLLSPKSENDKLKEISLACKITELESVSLPTPEIQSDFLHSKVEAPPSEVADTLVIMTASKGVRLPEPKDKILETPQKMTEKSESKTPGEGKKEDKSRMAEPMKGYMRPTKSRGLTPLLPKSTIQEQERHKQLKSAGIARPEEGRPVVSGTGNDITTPPNKELPPSPEKKTKPLATTQPAKTSTSKAKTQPTSLPKQPAPTTIGGLNKKPMSLASGLVPAAPPKRPAVASARPSILPSKDVKPKPIADAKAPEKRASPSKPASAPASRSGSKSTQTVAKTTTAAAVASTGPSSRSPSTLLPKKPTAIKTEGKPAEVKKMTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRAKVEKKTEAAATTRKPESNAVTKTAGPIASAQKQPAGKVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKTEGGGSEAPLCPGPPAGEEPAISEAAPEAGAPTSASGLNGHPTLSGGGDQREAQTLDSQIQETSI

SEQ ID NO: 53577 - protein, 249 aa, Homo sapiens
MTAKSVPADLSRPKSTSTSSMKKTTTLSGTAPAAGVVPSRVKATPMPSRPSTTPFIDKKPTSAKPSSTTPRLSRLATNTSAPDLKNVRSKVGSTENIKHQPGGGRVQIVSKKVSYSHIQSKCGSKDNIKHVPGGGNVQIQNKKVDISKVSSKCGSKANIKHKPGGGDVKIESQKLNFKEKAQAKVGSLDNVGHLPAGGAVKIETYRLTFRANARARTDHGADIVSRPPHFPGGPNSGSRVLGPLSRAVH

SEQ ID NO: 53578 - protein, 99 aa, Homo sapiens
MADLSLADALTEPSPDIEGEIKRDFIATLEAEAFDDVVGETVGKTDYIPLLDVDEKTGNSESKKKPCSETSQIEDTPSSKPTLLANGGHGVEGSDTTEA

SEQ ID NO: 53579 - protein, 758 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53580 - protein, 383 aa, Homo sapiens
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53581 - protein, 412 aa, Homo sapiens
MAEPRQEFEVMEDHAGTYGLGDRKDQGGYTMHQDQEGDTDAGLKESPLQTPTEDGSEEPGSETSDAKSTPTAEAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53582 - protein, 776 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQEPESGKVVQEGFLREPGPPGLSHQLMSGMPGAPLLPEGPREATRQPSGTGPEDTEGGRHAPELLKHQLLGDLHQEGPPLKGAGGKERPGSKEEVDEDRDVDESSPQDSPPSKASPAQDGRPPQTAAREATSIPGFPAEGAIPLPVDFLSKVSTEIPASEPDGPSVGRAKGQDAPLEFTFHVEITPNVQKEQAHSEEHLGRAAFPGAPGEGPEARGPSLGEDTKEADLPEPSEKQPAAAPRGKPVSRVPQLKARMVSKSKDGTGSDDKKAKTSTRSSAKTLKNRPCLSPKHPTPGSSDPLIQPSSPAVCPEPPSSPKYVSSVTSRTGSSGAKEMKLKGADGKTKIATPRGAAPPGQKGQANATRIPAKTPPAPKTPPSSATKQVQRRPPPAGPRSERGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53583 - protein, 316 aa, Homo sapiens
MLRALQQRKREAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53584 - protein, 441 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIINKKLDLSNVQSKCGSKDNIKHVPGGGSVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53585 - protein, 359 aa, Homo sapiens
MAEPRQEFEVMEDHAGTYGLGDRKDQGGYTMHQDQEGDTDAGLKESPLQTPTEDGSEEPGSETSDAKSTPTAEARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53586 - protein, 776 aa, Homo sapiens; identical to SEQ ID NO: 53582

SEQ ID NO: 53587 - protein, 412 aa, Homo sapiens; identical to SEQ ID NO: 53581

SEQ ID NO: 53588 - protein, 264 aa, Homo sapiens
TREAEGADGKTKIATPKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53589 - protein, 352 aa, Homo sapiens
MAEPRQEFEVMEDHAGTYGLGDRKDQGGYTMHQDQEGDTDAGLKAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53590 - protein, 410 aa, Homo sapiens
MAEPRQEFEVMEDHAGTYGLGDRKDQGGYTMHQDQEGDTDAGLKESPLQTPTEDGSEEPGSETSDAKSTPTAEDVTAPLVDEGAPGKQAAAQPHTEIPEGTTAEEAGIGDTPSLEDEAAGHVTQARMVSKSKDGTGSDDKKAKGADGKTKIATPRGAAPPGQKGQANATRIPAKTPPAPKTPPSSGEPPKSGDRSGYSSPGSPGTPGSRSRTPSLPTPPTREPKKVAVVRTPPKSPSSAKSRLQTAPVPMPDLKNVKSKIGSTENLKHQPGGGKVQIVYKPVDLSKVTSKCGSLGNIHHKPGGGQVEVKSEKLDFKDRVQSKIGSLDNITHVPGGGNKKIETHKLTFRENAKAKTDHGAEIVYKSPVVSGDTSPRHLSNVSSTGSIDMVDSPQLATLADEVSASLAKQGL

SEQ ID NO: 53591 - protein, 268 aa, Homo sapiens
MAVNVYSTSVTSDNLSRHDMLAWINESLQLNLTKIEQLCSGAAYCQFMDMLFPGSIALKKVKFQAKLEHEYIQNFKILQAGFKRMGVDKIIPVDKLVKGKFQDNFEFVQWFKKFFDANYDGKDYDPVAARQGQETAVAPSLVAPALNKPKKPLTSSSAAPQRPISTQRTAAAPKAGPGVVRKNPGVGNGDDEAAELMQQVNVLKLTVEDLEKERDFYFGKLRNIELICQENEGENDPVLQRIVDILYATDEGFVIPDEGGPQEEQEEY

SEQ ID NO: 53592 - protein, 327 aa, Homo sapiens
MPGPTQTLSPNGENNNDIIQDNNGTIIPFRKHTVRGERSYSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 53593 - protein, 284 aa, Homo sapiens
MAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 53594 - protein, 315 aa, Homo sapiens
MKQNRDQKCPVSQRNSSFQQPGRKPGCSSWGMAVNVYSTSITQETMSRHDIIAWVNDIVSLNYTKVEQLCSGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 53595 - protein, 274 aa, Homo sapiens
MARTTTTSSRIITGPSFLSGSTQCAGSVPTGAAYCQFMDMLFPGCISLKKVKFQAKLEHEYIHNFKLLQASFKRMNVDKVIPVEKLVKGRFQDNLDFIQWFKKFYDANYDGKEYDPVEARQGQDAIPPPDPGEQIFNLPKKSHHANSPTAGAAKSSPAAKPGSTPSRPSSAKRASSSGSASKSDKDLETQVIQLNEQVHSLKLALEGVEKERDFYFGKLREIELLCQEHGQENDDLVQRLMDILYASEEHEGHTEEPEAEEQAHEQQPPQQEEY

SEQ ID NO: 53596 - protein, 281 aa, Homo sapiens
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPGDQIFNKSKKLIGTAVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 53597 - protein, 266 aa, Homo sapiens
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPVPQRTSPTGPKNMQTSGRLSNVAPPCILRKNPPSARNGGHETDAQILELNQQLVDLKLTVDGLEKERDFYFSKLRDIELICQEHESENSPVISGIIGILYATEEGFAPPEDDEIEEHQQEDQDEY

SEQ ID NO: 53598 - protein, 266 aa, Homo sapiens; identical to SEQ ID NO: 53597

SEQ ID NO: 53599 - protein, 218 aa, Homo sapiens
MAVNVYSTSVTSENLSRHDMLAWVNDSLHLNYTKIEQLCSGAAYCQFMDMLFPGCVHLRKVKFQAKLEHEYIHNFKVLQAAFKKMGVDKIIPVEKLVKGKFQDNFEFIQWFKKFFDANYDGKDYNPLLARQGQDVAPPPNPGDQIFNKSKKLIGTAVPQRTSPTGPKNMQTSGRLSNVAPPCILRKNPPSARNGGHETDAQILELNQQLVDLKLTVDG

SEQ ID NO: 53600 - protein, 667 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 53601 - protein, 667 aa, Homo sapiens; identical to SEQ ID NO: 53600

SEQ ID NO: 53602 - protein, 667 aa, Homo sapiens; identical to SEQ ID NO: 53600

SEQ ID NO: 53603 - protein, 552 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTW

SEQ ID NO: 53604 - protein, 667 aa, Homo sapiens; identical to SEQ ID NO: 53600

SEQ ID NO: 53605 - protein, 667 aa, Homo sapiens; identical to SEQ ID NO: 53600

SEQ ID NO: 53606 - protein, 483 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICALCKLVGRHRDHQVAALSERYDKLKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNS

SEQ ID NO: 53607 - protein, 197 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETRRERAFDANTMTSAEKVLCQFCDQDPAQDAVKTCVTCEVSYCDECLKATHPNKKPFTGHRLIEPIPDSHIRGLMCLEHEDEKVNMYCVTDDQLICAL

SEQ ID NO: 53608 - protein, 667 aa, Homo sapiens; identical to SEQ ID NO: 53600

SEQ ID NO: 53609 - protein, 617 aa, Homo sapiens
METLESELTCPICLELFEDPLLLPCAHSLCFNCAHRILVSHCATNESVESITAFQCPTCRHVITLSQRGLDGLKRNVTLQNIIDRFQKASVSGPNSPSETSAEKVLCQFCDQDPAQDAVKTCVTCEVSYCDECLKATHPNKKPFTGHRLIEPIPDSHIRGLMCLEHEDEKQNLESNLTNLIKRNTELETLLAKLIQTCQHVEVNASRQEAKLTEECDLLIEIIQQRRQIIGTKIKEGKVMRLRKLAQQIANCKQCIERSASLISQAEHSLKENDHARFLQTAKNITERVSMATASSQVLIPEINLNDTFDTFALDFSREKKLLECLDYLTAPNPPTIREELCTASYDTITVHWTSDDEFSVVSYELQYTIFTGQANVVSLCNSADSWMIVPNIKQNHYTVHGLQSGTKYIFMVKAINQAGSRSSEPGKLKTNSQPFKLDPKSAHRKLKVSHDNLTVERDESSSKKSHTPERFTSQGSYGVAGNVFIDSGRHYWEVVISGSTWYAIGLAYKSAPKHEWIGKNSASWALCRCNNNWVVRHNSKEIPIEPAPHLRRVGILLDYDNGSIAFYDALNSIHLYTFDVAFAQPVCPTFTVWNKCLTIITGLPIPDHLDCTEQLP

SEQ ID NO: 53610 - protein, 735 aa, Homo sapiens
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISKSWCSWGLWPEIRKCKEAVSCSRLAGAPRGLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 53611 - protein, 705 aa, Homo sapiens
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNSELENQMAKLIQICQQVEVNTAMHEAKLMEECDELVEIIQQRKQMIAVKIKETKVMKLRKLAQQVANCRQCLERSTVLINQAEHILKENDQARFLQSAKNIAERVAMATASSQVLIPDINFNDAFENFALDFSREKKLLEGLDYLTAPNPPSIREELCTASHDTITVHWISDDEFSISSYELQYTIFTGQANFISLYNSVDSWMIVPNIKQNHYTVHGLQSGTRYIFIVKAINQAGSRNSEPTRLKTNSQPFKLDPKMTHKKLKISNDGLQMEKDESSLKKSHTPERFSGTGCYGAAGNIFIDSGCHYWEVVMGSSTWYAIGIAYKSAPKNEWIGKNASSWVFSRCNSNFVVRHNNKEMLVDVPPHLKRLGVLLDYDNNMLSFYDPANSLHLHTFDVTFILPVCPTFTIWNKSLMILSGLPAPDFIDYPERQECNCRPQESPYVSGMKTCH

SEQ ID NO: 53612 - protein, 219 aa, Homo sapiens
METLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKL

SEQ ID NO: 53613 - protein, 468 aa, Homo sapiens
MEPQPGGARSCRRGAPGGACELGPAAEAAPMSLAIHSTTGTRYDLAVPPDETVEGLRKRLSQRLKVPKERLALLHKDTRLSSGKLQEFGVGDGSKLTLVPTVEAGLMSQASRPEQSVMQALESLTETQVSDFLSGRSPLTLALRVGDHMMFVQLQLAAQHAPLQHRHVLAAAAAAAAARGDPSIASPVSSPCRPVSSAARVPPVPTSPSPASPSPITAGSFRSHAASTTCPEQMDCSPTASSSASPGASTTSTPGASPAPRSRKPGAVIESFVNHAPGVFSGTFSGTLHPNCQDSSGRPRRDIGTILQILNDLLSATRHYQGMPPSLAQLRCHAQCSPASPAPDLAPRTTSCEKLTAAPSASLLQGQSQIRMCKPPGDRLRQTENRATRCKVERLQLLLQQKRLRRKARRDARGPYHWSPSRKAGRSDSSSSGGGGSPSEASGLGLDFEDSVWKPEVNPDIKSEFVVA

SEQ ID NO: 53614 - protein, 256 aa, Homo sapiens
MGEPSREEYKIQSFDAETQQLLKTALKVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 53615 - protein, 222 aa, Homo sapiens
MGEPSREEYKIQSFDAETQQLLKTALKDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 53616 - protein, 263 aa, Homo sapiens
MGEPSREEYKIQSFDAETQQLLKTALKAPSLECTVACFETEDGEYSVCQRSYSNCSRLMPSRCNTQYRDPGAVDLEKVANVIVDHSLQDCVFSKEAGRMCYAIIQAESKQAGQSVFRRGLLNRLQQEYQAREQLRARSLQGWVCYVTFICNIFDYLRVNNMPMMALVNPVYDCLFRLAQPDSLSKEEEVDCLVLQLHRVGEQLEKMNGQRMDELFVLIRDGFLLPTGLSSLAQLLLLEIIEFRAAGWKTTPAAHKYYYSEVSD

SEQ ID NO: 53617 - protein, 387 aa, Homo sapiens
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 53618 - protein, 379 aa, Homo sapiens
MWPFPEGGNTIPILHTDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQVDLGSSKEVTGIITQGARNFGSVQFVASYKVAYSNDSANWTEYQDPRTGSSKIFPGNWDNHSHKKNLFETPILARYVRILPVAWHNRIALRLELLGC

SEQ ID NO: 53619 - protein, 335 aa, Homo sapiens
MPRPRLLAALCGALLCAPSLLVALDICSKNPCHNGGLCEEISQEVRGDVFPSYTCTCLKGYAGNHCETKCVEPLGLENGNIANSQIAASSVRVTFLGLQHWVPELARLNRAGMVNAWTPSSNDDNPWIQVNLLRRMWVTGVVTQGASRLASHEYLKAFKVAYSLNGHEFDFIHDVNKKHKEFVGNWNKNAVHVNLFETPVEAQYVRLYPTSCHTACTLRFELLGCELNGCANPLGLKNNSIPDKQITASSSYKTWGLHLFSWNPSYARLDKQGNFNAWVAGSYGNDQWLQIFPGNWDNHSHKKNLFETPILARYVRILPVAWHNRIALRLELLGC

SEQ ID NO: 53620 - protein, 642 aa, Homo sapiens
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTCKFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 53621 - protein, 640 aa, Homo sapiens
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDILELYGILSVDPVLSILNNDERDASALLDPMECTDTAEEQRVHSPPASLVPRIHVILAQKLQHINPLLPACLNKEESKTFVSSFMSELSPVRAELLGFLTHALLGDSLAAEYLILHLISTVYTRRDVLPLGKFTVNLSGCPRNSTFTEHLYRIIQHLVPASFRLQMTIENMNHLKFIPHKDYTANRLVSGLLQLPSNTSLVIDETLLEQGQLDTPGVHNVTALSNLITWQKVDYDFSYHQMEFPCNINVFITSEGRSLLPADCQIHLQPQLIPPNMEEYMNSLLSAVLPSVLNKFRIYLTLLRFLEYSISDEITKAVEDDFVEMRKNDPQSITADDLHQLLVVARCLSLSAGQTTLSRERWLRAKQLESLRRTRLQQQKCVNGNEL

SEQ ID NO: 53622 - protein, 875 aa, Homo sapiens
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPVEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 53623 - protein, 855 aa, Homo sapiens
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKVCHLRTNF

SEQ ID NO: 53624 - protein, 874 aa, Homo sapiens
MDEEEDNLSLLTALLEENESALDCNSEENNFLTRENGEPDAFDELFDADGDGESYTEEADDGETGETRDEKENLATLFGDMEDLTDEEEVPASQSTENRVLPAPAPRREKTNEELQEELRNLQEQMKALQEQLKVTTIKQTASPARLQKSPEKSPRPPLKERRVQRIQESTCFSAELDVPALPRTKRVARTPKASPPDPKSSSSRMTSAPSQPLQTISRNKPSGITRGQIVGTPGSSGETTQPICVEAFSGLRLRRPRVSSTEMNKKMTGRKLIRLSQIKEKMAREKLEEIDWVTFGVILKKVTPQSVNSGKTFSIWKLNDLRDLTQCVSLFLFGEVHKALWKTEQGTVVGILNANPMKPKDGSEEVCLSIDHPQKVLIMGEALDLGTCKAKKKNGEPCTQTVNLRDCEYCQYHVQAQYKKLSAKRADLQSTFSGGRIPKKFARRGTSLKERLCQDGFYYGGVSSASYAASIAAAVAPKKKIQTTLSNLVVKGTNLIIQETRQKLGIPQKSLSCSEEFKELMDLPTCGARNLKQHLAKATASGIMGSPKPAIKSISASALLKQQKQRMLEMRRRKSEEIQKRFLQSSSEVESPAVPSSSRQPPAQPPRTGSEFPRLEGAPATMTPKLGRGVLEGDDVLFYDESPPPRPKLSALAEAKKLAAITKLRAKGQVLTKTNPNSIKKKQKDPQDILEVKERVEKNTMFSSQAEDELEPARKKRREQLAYLESEEFQKILKAKSKHTGILKEAEAEMQERYFEPLVKKEQMEEKMRNIREVKCRVVTCKTCAYTHFKLLETCVSEQHEYHWHDGVKRFFKCPCGNRSISLDRLPNKHCSNCGLYKWERDGMLKEKTGPKIGGETLLPRGEEHAKFLNSLK

SEQ ID NO: 53625 - protein, 875 aa, Homo sapiens; identical to SEQ ID NO: 53622

SEQ ID NO: 53626 - protein, 821 aa, Homo sapiens
MDLAAAAEPGAGSQHLEVRDEVAEKCQKLFLDFLEEFQSSDGEIKYLQLAEELIRPERNTLVVSFVDLEQFNQQLSTTIQEEFYRVYPYLCRALKTFVKDRKEIPLAKDFYVAFQDLPTRHKIRELTSSRIGLLTRISGQVVRTHPVHPELVSGTFLCLDCQTVIRDVEQQFKYTQPNICRNPVCANRRRFLLDTNKSRFVDFQKVRIQETQAELPRGSIPRSLEVILRAEAVESAQAGDKCDFTGTLIVVPDVSKLSTPGARAETNSRVSGVDGYETEGIRGLRALGVRDLSYRLVFLACCVAPTNPRFGGKELRDEEQTAESIKNQMTVKEWEKVFEMSQDKNLYHNLCTSLFPTIHGNDEVKRGVLLMLFGGVPKTTGEGTSLRGDINVCIVGDPSTAKSQFLKHVEEFSPRAVYTSGKASSAAGLTAAVVRDEESHEFVIEAGALMLADNGVCCIDEFDKMDVRDQVAIHEAMEQQTISITKAGVKATLNARTSILAAANPISGHYDRSKSLKQNINLSAPIMSRFDLFFILVDECNEVTDYAIARRIVDLHSRIEESIDRVYSLDDIRRYLLFARQFKPKISKESEDFIVEQYKHLRQRDGSGVTKSSWRITVRQLESMIRLSEAMARMHCCDEVQPKHVKEAFRLLNKSIIRVETPDVNLDQEEEIQMEVDEGAGGINGHADSPAPVNGINGYNEDINQESAPKASLRLGFSEYCRISNLIVLHLRKVEEEEDESALKRSELVNWYLKEIESEIDSEEELINKKRIIEKVIHRLTHYDHVLIELTQAGLKGSTEGSESYEEDPYLVVNPNYLLED

SEQ ID NO: 53627 - protein, 719 aa, Homo sapiens
MALKDYALEKEKVKKFLQEFYQDDELGKKQFKYGNQLVRLAHREQVALYVDLDDVAEDDPELVDSICENARRYAKLFADAVQELLPQYKEREVVNKDVLDVYIEHRLMMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIAEEDFYEKLAASIAPEIYGHEDVKKALLLLLVGGVDQSPRGMKIRGNINICLMGDPGVAKSQLLSYIDRLAPRSQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTARTQRPADVIFATVRELVSGGRSVRFSEAEQRCVSRGFTPAQFQAALDEYEELNVWQVNASRTRITFV

SEQ ID NO: 53628 - protein, 389 aa, Homo sapiens
MALKDYALEKEKVKKFLQEFYQDDELGKKQFKYGNQLVRLAHREQVALYVDLDDVAEDDPELVDSICENARRYAKLFADAVQELLPQYKEREVVNKDVLDVYIEHRLMMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIADVIFATVRELVSGGRSVRFSEAEQRCVSRGFTPAQFQAALDEYEELNVWQVNASRTRITFV

SEQ ID NO: 53629 - protein, 543 aa, Homo sapiens
MVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIAEEDFYEKLAASIAPEIYGHEDVKKALLLLLVGGVDQSPRGMKIRGNINICLMGDPGVAKSQLLSYIDRLAPRSQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTARTQRPADVIFATVRELVSGGRSVRFSEAEQRCVSRGFTPAQFQAALDEYEELNVWQVNASRTRITFV

SEQ ID NO: 53630 - protein, 612 aa, Homo sapiens
MMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIAEEDFYEKLAASIAPEIYGHEDVKKALLLLLVGGVDQSPRGMKIRGNINICLMGDPGVAKSQLLSYIDRLAPRSQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTARTQRPADVIFATVRELVSGGRSVRFSEAEQRCVSRGFTPAQFQAALDEYEELNVWQVNASRTRITFV

SEQ ID NO: 53631 - protein, 656 aa, Homo sapiens
MTPSWWTQFVRMPGATRSSLLMPYYKEREVVNKDVLDVYIEHRLMMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITVLVEGENTRIAQPGDHVSVTGIFLPILRTGFRQVVQGLLSETYLEAHRIVKMNKSEDDESGAGELTREELRQIAEEDFYEKLAASIAPEIYGHEDVKKALLLLLVGGVDQSPRGMKIRGNINICLMGDPGVAKSQLLSYIDRLAPRSQYTTGRGSSGVGLTAAVLRDSVSGELTLEGGALVLADQGVCCIDEFDKMAEADRTAIHEVMEQQTISIAKAGILTTLNARCSILAAANPAYGRYNPRRSLEQNIQLPAALLSRFDLLWLIQDRPDRDNDLRLAQHITYVHQHSRQPPSQFEPLDMKLMRRYIAMCREKQPMVPESLADYITAAYVEMRREAWASKDATYTSARTLLAILRLSTALARLRMVDVVEKEDVNEAIRLMEMSKDSLLGDKGQTARTQRPADVIFATVRELVSGGRSVRFSEAEQRCVSRGFTPAQFQAALDEYEELNVWQVNASRTRITFV

SEQ ID NO: 53632 - protein, 824 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 53633 - protein, 793 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVNSLCPVIFGHEAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 53634 - protein, 880 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVKWSLALSPRLEYSGAISAHCNLHLPSSNSSPTSACRVAGTTGMRHQTQLLLLVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 53635 - protein, 840 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHARVYNYEPLTQLKNVRANYYGKYIALRGTVVRVSNIKPLCTKMAFLCAACGEIQSFPLPDGKYSLPTKCPVPVCRGRSFTALRSSPLTVTMDWQSIKIQELMSDDQREAGRIPRTIECELVHDLVDSCVPGDTVTITGIVKVSNAEEGSRNKNDKCMFLLYIEANSISNSKGQKTKSSEDGCKHGMLMEFSLKDLYAIQEIQAEENLFKLIVNSLCPVIFGHELVKAGLALALFGGSQKYADDKNRIPIRGDPHILVVGDPGLGKSQMLQAACNVAPRGVYVCGNTTTTSGLTVTLSKDSSSGDFALEAGALVLGDQGICGIDEFDKMGNQHQALLEAMEQQSISLAKAGVVCSLPARTSIIAAANPVGGHYNKAKTVSENLKMGSALLSRFDLVFILLDTPNEHHDHLLSEHVIAIRAGKQRTISSATVARMNSQDSNTSVLEVVSEKPLSERLKVVPGETIDPIPHQLLRKYIGYARQYVYPRLSTEAARVLQDFYLELRKQSQRLNSSPITTRQLESLIRLTEARARLELREEATKEDAEDIVEIMKYSMLGTYSDEFGNLDFERSQHGSGMSNRSTAKRFISALNNVAERTYNNIFQFHQLRQIAKELNIQVADFENFIGSLNDQGYLLKKGPKVYQLQTM

SEQ ID NO: 53636 - protein, 203 aa, Homo sapiens
MNGEYRGRGFGRGRFQSWKRGRGGGNFSGKWREREHRPDLSKTTGKRTSEQTPQFLLSTKTPQSMQSTLDRFIPYKGWKLYFSEVYSDSSPLIEKIQAFEKFFTRHIDLYDKDEIERKGSILVDFKELTEGGEVTNLIPDIATELRDAPEKTLACMGLAIHQVLTKDLERHAAELQAQEGLSNDGETMVNVPHIHFLKKKKKI

SEQ ID NO: 53637 - protein, 442 aa, Homo sapiens
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVTSDSDKEKTIAFLLKELDILRTSNKKLQQKLAKEDKEQRKLKFKLELQEKETEAKIAEKTAALVEEVYFAQKERDEAVMSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKLERLVDVLRKKVGTGTMRTVI

SEQ ID NO: 53638 - protein, 442 aa, Homo sapiens; identical to SEQ ID NO: 53637

SEQ ID NO: 53639 - protein, 261 aa, Homo sapiens
MSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKLERLVDVLRKKVGTGTMRTVI

SEQ ID NO: 53640 - protein, 442 aa, Homo sapiens; identical to SEQ ID NO: 53637

SEQ ID NO: 53641 - protein, 424 aa, Homo sapiens
MNSEKSMHRKSTELVNEITCENTEWPGQRSTNFQIISSYPDDESVYCTTEKYNVMEHRHNDMHYECMTPCQVTSDSDKEKTIAFLLKELDILRTSNKKLQQKLAKEDKEQRKLKFKLELQEKETEAKIAEKTAALVEEVYFAQKERDEAVMSRLQLAIEERDEAIARAKHMEMSLKVLENINPEENDMTLQELLNRINNADTGIAIQKNGAIIVDRIYKTKECKMRITAEEMSALIEERDAALSKCKRLEQELHHVKEQNQTSANNMRHLTAENNQERALKAKLLSMQQARETAVQQYKKLEEEIQTLRVYYSLHKSLSQEENLKDQFNYTLSTYEEALKNRENIVSITQQQNEELATQLQQALTERANMELQLQHAREASQVANEKVQKSQIQIYFIPNKKDEREKFLMDKRRKIVAHSKQNS

SEQ ID NO: 53642 - protein, 104 aa, Homo sapiens
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVT

SEQ ID NO: 53643 - protein, 128 aa, Homo sapiens
MENWSKDITHSYLEQETTGINKSTQPDEQLTMNSEKSMHRKSTELVNEITCENTEWPGQRSTNFQIISSYPDDESVYCTTEKYNVMEHRHNDMHYECMTPCQVTSDSDKEKTIAFLLKELDILRTSNK

SEQ ID NO: 53644 - protein, 1303 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRASNPDLRRSDPGWERSDSVLPASHGHLPQAGSLERNRVGVSSKPDSSPVLSPGNKAKPDDHRSRPGRPASYKRAIGEDFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 53645 - protein, 1332 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLVAHRVPLKPYAAPVPRSQSLQDQPTRNLAAFPASHDPDPAIPAPTATPSARGAVIRQNSDPTSEGPGPSPNPPAWVRPDNEAPPKVPQRTSSIATALNTSGAGGSRPAQAVRARPRSNSAWQIYLQRRAERGTPKPPGPPAQPPGPPNASSNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 53646 - protein, 1312 aa, Homo sapiens
MGDPAPARSLDDIDLSALRDPAGIFELVEVVGNGTYGQVYKGRHVKTGQLAAIKVMDVTEDEEEEIKQEINMLKKYSHHRNIATYYGAFIKKSPPGNDDQLWLVMEFCGAGSVTDLVKNTKGNALKEDCIAYICREILRGLAHLHAHKVIHRDIKGQNVLLTENAEVKLVDFGVSAQLDRTVGRRNTFIGTPYWMAPEVIACDENPDATYDYRSDIWSLGITAIEMAEGAPPLCDMHPMRALFLIPRNPPPRLKSKKWSKKFIDFIDTCLIKTYLSRPPTEQLLKFPFIRDQPTERQVRIQLKDHIDRSRKKRGEKEETEYEYSGSEEEDDSHGEEGEPSSIMNVPGESTLRREFLRLQQENKSNSEALKQQQQLQQQQQRDPEAHIKHLLHQRQRRIEEQKEERRRVEEQQRREREQRKLQEKEQQRRLEDMQALRREEERRQAEREQEYKRKQLEEQRQSERLQRQLQQEHAYLKSLQQQQQQQQLQKQQQQQLLPGDRKPLYHYGRGMNPADKPAWAREVEERTRMNKQQNSPLAKSKPGSTGPEPPIPQASPGPPGPLSQTPPMQRPVEPQEGPHKSLQDQPTRNLAAFPASHDPDPAIPAPTATPSARGAVIRQNSDPTSEGPGPSPNPPAWVRPDNEAPPKVPQRTSSIATALNTSGAGGSRPAQAVRARPRSNSAWQIYLQRRAERGTPKPPGPPAQPPGPPNASSNPDLRRSDPGWERSDSVLPASHGHLPQAGSLERNRVGVSSKPDSSPVLSPGNKAKPDDHRSRPGRPADFVLLKERTLDEAPRPPKKAMDYSSSSEEVESSEDDEEEGEGGPAEGSRDTPGGRSDGDTDSVSTMVVHDVEEITGTQPPYGGGTMVVQRTPEEERNLLHADSNGYTNLPDVVQPSHSPTENSKGQSPPSKDGSGDYQSRGLVKAPGKSSFTMFVDLGIYQPGGSGDSIPITALVGGEGTRLDQLQYDVRKGSVVNVNPTNTRAHSETPEIRKYKKRFNSEILCAALWGVNLLVGTENGLMLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 53647 - protein, 292 aa, Homo sapiens
MLLDRSGQGKVYGLIGRRRFQQMDVLEGLNLLITISGKRNKLRVYYLSWLRNKILHNDPEVEKKQGWTTVGDMEGCGHYRVVKYERIKFLVIALKSSVEVYAWAPKPYHKFMAFKSFADLPHRPLLVDLTVEEGQRLKVIYGSSAGFHAVDVDSGNSYDIYIPVHIQSQITPHAIIFLPNTDGMEMLLCYEDEGVYVNTYGRIIKDVVLQWGEMPTSVAYICSNQIMGWGEKAIEIRSVETGHLDGVFMHKRAQRLKFLCERNDKVFFASVRSGGSSQVYFMTLNRNCIMNW

SEQ ID NO: 53648 - protein, 111 aa, Homo sapiens
MGDPAPARSLDDIDLSALRALWFQFFYHSGSSLESPGMLNGPFQHRNSRIMTHRSAEKTLLGSLSLWRWSAMEPTDRCTRVGMSRRGSWLPSRSWMSRRTRRKRSNRRSTC

SEQ ID NO: 53649 - protein, 337 aa, Homo sapiens
MGAAGSSALARFVLLAQSRPGWLGVAALGLTAVALGAVAWRRAWPTRRRRLLQQVGTVAQLWIYPVKSCKGVPVSEAECTAMGLRSGNLRDRFWLVINQEGNMVTARQEPRLVLISLTCDGDTLTLSAAYTKDLLLPIKTPTTNAVHKCRVHGLEIEGRDCGEATAQWITSFLKSQPYRLVHFEPHMRPRRPHQIADLFRPKDQIAYSDTSPFLILSEASLADLNSRLEKKVKATNFRPNIVISGCDVYAEDSWDELLIGDVELKRVMACSRCILTTVDPDTGVMSRKEPLETLKSYRQCDPSERKLYGKSPLFGQYFVLENPGTIKVGDPVYLLGQ

SEQ ID NO: 53650 - protein, 257 aa, Homo sapiens
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEASATRRD

SEQ ID NO: 53651 - protein, 335 aa, Homo sapiens
MGASSSSALARLGLPARPWPRWLGVAALGLAAVALGTVAWRRAWPRRRRRLQQVGTVAKLWIYPVKSCKGVPVSEAECTAMGLRSGNLRDRFWLVIKEDGHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPRCILTTVDPDTGVIDRKQPLDTLKSYRLCDPSERELYKLSPLFGIYYSVEKIGSLRVGDPVYRMV

SEQ ID NO: 53652 - protein, 172 aa, Homo sapiens
GHMVTARQEPRLVLISIIYENNCLIFRAPDMDQLVLPSKQPSSNKLHNCRIFGLDIKGRDCGNEAAKWFTNFLKTEAYRLVQFETNMKGRTSRKLLPTLDQNFQVAYPDYCPLLIMTDASLVDLNTRMEKKMKMENFRPNIVVTGCDAFEEDTWDELLIGSVEVKKVMACPR

SEQ ID NO: 53653 - protein, 148 aa, Homo sapiens
MPFAEDKTYKYICRNFSNFCNVDVVEILPYLPCLTARDQDRLRATCTLSGNRDTLWHLFNTLQLPTWAGEETPGGQSSGRGLDFSSLTSGAVWLWQMSDFWSCFSTWTVSIWLILHWVLLRLNLQVFAKCLAQSKWPLLLPSLSCPTW

SEQ ID NO: 53654 - protein, 124 aa, Homo sapiens
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPQFRASPADAQPQSHPKESRWWPPGVLL

SEQ ID NO: 53655 - protein, 399 aa, Homo sapiens
MPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 53656 - protein, 540 aa, Homo sapiens
MPFAEDKTYKYICRNFSNFCNVDVVEILPYLPCLTARDQDRLRATCTLSGNRDTLWHLFNTLQRRPGWVEYFIAALRGCELVDLADEVASVYQSYQPRTSDRPPDPLEPPSLPAERPGPPTPAAAHSIPYNSCREKEPSYPMPVQETQAPESPGENSEQALQTLSPRAIPRNPDGGPLESSSDLAALSPLTSSGHQEQDTELGSTHTAGATSSLTPSRGPVSPSVSFQPLARSTPRASRLPGPTGSVVSTGTSFSSSSPGLASAGAAEGKQGAESDQAEPIICSSGAEAPANSLPSKVPTTLMPVNTVALKVPANPASVSTVPSKLPTSSKPPGAVPSNALTNPAPSKLPINSTRAGMVPSKVPTSMVLTKVSASTVPTDGSSRNEETPAAPTPAGATGGSSAWLDSSSENRGLGSELSKPGVLASQVDSPFSGCFEDLAISASTSLGMGPCHGPEENEYKSEGTFGIHVAENPSIQLLEGNPGPPADPDGGPRPQADRKFQEREVPCHRPSPGALWLQVAVTGVLVVTLLVVLYRRRLH

SEQ ID NO: 53657 - protein, 330 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRVEMGFCHVGQNGFELLTSSYLPASASQSAEIIAVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 53658 - protein, 351 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 53659 - protein, 302 aa, Homo sapiens
MVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTWWEYSWDIMEPVTYFITYGSAMAMYAYFVMTRQEYVYPEARDRQYLLFFHKGAKKSRFDLEKYNQLKDAIAQAEMDLKRLRDPLQVHLPLRQIGEKD

SEQ ID NO: 53660 - protein, 303 aa, Homo sapiens
MADAASQVLLGSGLTILSQPLMYVKVLIQVGYEPLPPTIGRNIFGRQVCQLPGLFSYAQHIASIDGRRGLFTGLTPRLCSGVLGTVVHGKVLQHYQESDKGEELGPGNVQKEVSSSFDHVIKETTREMIARSAATLITHPFHVITLRSMVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 53661 - protein, 155 aa, Homo sapiens
MVQFIGRESKYCGLCDSIITIYREEGILGFFAGLVPRLLGDILSLWLCNSLAYLVNTYALDSGVSTMNEMKSYSQAVTGFFASMLTYPFVLVSNLMAVNNCGLAGGCPPYSPIYTSWIDCWCMLQKEGNMSRGNSLFFRKVPFGKTYCCDLKMLI

SEQ ID NO: 53662 - protein, 119 aa, Homo sapiens
MVLPLPWLSRYHFLRLLLPSWSLAPQGSHGCCSQNPKASMEEQTSSRGNGKMTSPPRGPGTHRTAELARAEELLEQQLELYQALLEGQEGAWEAQALVLKIQKLKEQMRRHQESLGGGA

SEQ ID NO: 53663 - protein, 119 aa, Homo sapiens
MVLPLPWLSRYHFLRLLLPSWSLAPQGSHGCCSQNPKASMEEQTNSRGNGKMTSPPRGPGTHRTAELARAEELLEQQLELYQALLEGQEGAWEAQALVLKIQKLKEQMRRHQESLGGGA

SEQ ID NO: 53664 - protein, 119 aa, Homo sapiens; identical to SEQ ID NO: 53663

SEQ ID NO: 53665 - protein, 119 aa, Homo sapiens; identical to SEQ ID NO: 53662

SEQ ID NO: 53666 - protein, 119 aa, Homo sapiens; identical to SEQ ID NO: 53662

SEQ ID NO: 53667 - protein, 119 aa, Homo sapiens [sequence omitted]

SEQ ID NO: 53668 - protein, 119 aa, Homo sapiens; identical to SEQ ID NO: 53663

SEQ ID NO: 53669 - protein, 119 aa, Homo sapiens; identical to SEQ ID NO: 53663

SEQ ID NO: 53670 - protein, 352 aa, Homo sapiens
MESGGRPSLCQFILLGTTSVVTAALYSVYRQKARVSQELKGAKKVHLGEDLKSILSEAPGKCVPYAVIEGAVRSVKETLNSQFVENCKGVIQRLTLQEHKMVWNRTTHLWNDCSKIIHQRTNTVPFDLVPHEDGVDVAVRVLKPLDSVDLGLETVYEKFHPSIQSFTDVIGHYISGERPKGIQETEEMLKVGATLTGVGELVLDNNSVRLQPPKQGMQYYLSSQDFDSLLQRQESSVRLWKVLALVFGFATCATLFFILRKQYLQRQERLRLKQMQEEFQEHEAQLLSRAKPEDRESLKSACVVCLSSFKSCVFLECGHVCSCTECYRALPEPKKCPICRQAITRVIPLYNS

SEQ ID NO: 53671 - protein, 713 aa, Homo sapiens
MLCVGRLGGLGARAAALPPRRAGRGSLEAGIRARRVSTSWSPVGAAFNVKPQGSRLDLFGERRGLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNPQNSEVMPWDPPYYSGVIRAERYNIEPSLYCPFFSLGACMEGLNILLNRLLGISLYAEQPAKGEVWSEDVRKLAVVHESEGLLGYIYCDFFQRADKPHQDCHFTIRGGRLKEDGDYQLPVVVLMLNLPRSSRSSPTLLTPSMMENLFHEMGHAMHSMLGRTRYQHVTGTRCPTDFAEVPSILMEYFANDYRVVNQFARHYQTGQPLPKNMVSRLCESKKVCAAADMQLQVFYATLDQIYHGKHPLRNSTTDILKETQEKFYGLPYVPNTAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 53672 - protein, 389 aa, Homo sapiens
MRVLVRRCWGPPLAHGARRGRPSPQWRALARLGWEDCRDSRVREKPPWRVLFFGTDQFAREALRALHAARENKEEELIDKLEVVTMPSPSPKGLPVKQYAVQSQLPVYEWPDVGSGEYDVGVVASFGRLLNEALILKFPYGILNVHPSCLPRWRGPAPVIHTVLHGDTVTGVTIMQIRPKRFDVGPILKQETVPVPPKSTAKELEAVLSRLGANMLISVLKNLPESLSNGRQQPMEGATYAPKISAGTSCIKWEEQTSEQIFRLYRAIGNIIPLQTLWMANTIKLLDLVEVNSSVLADPKLTGQALIPGSVIYHKQSQILLVYCKDGWIGVRSVMLKKSLTATDFYNGYLHPWYQKNSQAQPSQCRFQTLRLPTKKKQKKTVAMQQCIE

SEQ ID NO: 53673 - protein, 389 aa, Homo sapiens; identical to SEQ ID NO: 53672

SEQ ID NO: 53674 - protein, 582 aa, Homo sapiens
MAVPGVGLLTRLNLCARRRTRVQRPIVRLLSCPGTVAKDLRRDEQPSGSVETGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKILSVLGECLDHFGPGCVGVQKILNARCPLVRFSHQASGFQCDLTTNNRIALTSSELLYIYGALDSRVRALVFSVRCWARAHSLTSSIPGAWITNFSLTMMVIFFLQRRSPPILPTLDSLKTLADAEDKCVIEGNNCTFVRDLSRIKPSQNTETLELLLKEFFEYFGNFAFDKNSINIRQGREQNKPDSSPLYIQNPFETSLNISKNVSQSQLQKFVDLARESAWILQQEDTDRPSISSNRPWGLVSLLLPSAPNRKSFTKKKSNKFAIETVKNLLESLKGNRTENFTKTSGKRTISTQT

SEQ ID NO: 53675 - protein, 712 aa, Homo sapiens
MAWAKKVGGRAGQGRSLSRCDPIILDPEWLYGPPEGEGGPEGVGGETRASIHPPLRTGRHHQKVNHNIRGPEGSAKDAAPGGGGHHQAGPGQRGDEDGALQHLCGGGGGVGVSVGRGTGTSVAAEHPSLQVKLLELQELVLRLAGDHNEGHGKFLAAAQNPADDPAPGAPAPQELGAADKQGGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKILSVLGECLDHFGPGCVGVQKILNARCPLVRFSHQASGFQCDLTTNNRIALTSSELLYIYGALDSRVRALVFSVRCWARAHSLTSSIPGAWITNFSLTMMVIFFLQRRSPPILPTLDSLKTLADAEDKCVIEGNNCTFVRDLSRIKPSQNTETLELLLKEFFEYFGNFAFDKNSINIRQGREQNKPDSSPLYIQNPFETSLNISKNVSQSQLQKFVDLARESAWILQQEDTDRPSISSNRPWGLVSLLLPSAPNRKSFTKKKSNKFAIETVKNLLESLKGNRTENFTKTSGKRTISTQT

SEQ ID NO: 53676 - protein, 219 aa, Homo sapiens
MQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESIDDQLNTLLKEFQLTEENTKLRYLTCSLIEDMAAAYFPDCIVRPFGSSVNTFGKLGCDLDMFLDLDETRNLSAHKISGNFLMEFQVKNVPSERIATQKI

SEQ ID NO: 53677 - protein, 150 aa, Homo sapiens
DLRRDEQPSGSVETGFEDKIPKRRFSEMQNERREQAQRTVLIHCPEKISENKFLKYLSQFGPINNHFFYESFGLYAVVEFCQKESIGSLQNGTHTPSTAMETAIPFRSRFFNLKLKNQTSERSRVRSSNQLPRSNKQLFELLCYAESVSF

SEQ ID NO: 53678 - protein, 102 aa, Homo sapiens
MFLTALLWRGRIPGRQWIGKHRRPRFVSLRAKQNMIRRLEIEAENHYWLSMPYMTREQERGHAAVRRREAFEAIKAAATSKFPPHRFIADQLDHLNVTKKWS

SEQ ID NO: 53679 - protein, 325 aa, Homo sapiens
MAAAVRCMGRALIHHQRHSLSKMVYQTSLCSCSVNIRVPNRHFAAATKSAKKTKKGAKEKTPDEKKDEIEKIKAYPYMEGEPEDDVYLKRLYPRQIYEVEKAVHLLKKFQILDFTSPKQSVYLDLTLDMALGKKKNVEPFTSVLSLPYPFASEINKVAVFTENASEVKIAEENGAAFAGGTSLIQKIWDDEIVADFYVAVPEIMPELNRLRKKLNKKYPKLSRNSIGRDIPKMLELFKNGHEIKVDEERENFLQTKIATLDMSSDQIAANLQAVINEVCRHRPLNLGPFVVRAFLRSSTSEGLLLKIDPLLPKEVKNEESEKEDA

SEQ ID NO: 53680 - protein, 302 aa, Homo sapiens
MVYQTSLCSCSVNIRVPNRHFAAATKSAKKTKKGAKEKTPDEKKDEIEKIKAYPYMEGEPEDDVYLKRLYPRQIYEVEKAVHLLKKFQILDFTSPKQSVYLDLTLDMALGKKKNVEPFTSVLSLPYPFASEINKVAVFTENASEVKIAEENGAAFAGGTSLIQKIWDDEIVADFYVAVPEIMPELNRLRKKLNKKYPKLSRNSIGRDIPKMLELFKNGHEIKVDEERENFLQTKIATLDMSSDQIAANLQAVINEVCRHRPLNLGPFVVRAFLRSSTSEGLLLKIDPLLPKEIKSQPKKKKN

SEQ ID NO: 53681 - protein, 271 aa, Homo sapiens
MISAHCNLHLPGSSDSPASASQVAGITGRLPTLQTVRYGSKAVTRHRRVMHFQRQKLMAVTEYIPPKPAIHPSCLPSPPSPPQEEIGLIRLLRREIAAVFQDNRMIAVCQNVALSAEDKLLMRHQLRKHKILMKVFPNQVLKPFLEDSKYQNLLPLFVGHNMLLVSEEPKVKEMVRILRTVPFLPLLGGCIDDTILSRQGFINYSKLPSLPLVQGELVGGLTCLTAQTHSLLQHQPLQLTTLLDQYIREQREKDSVMSANGKPDPDTVPDS

SEQ ID NO: 53682 - protein, 261 aa, Homo sapiens [sequence omitted]

SEQ ID NO: 53683 - protein, 271 aa, Homo sapiens; identical to SEQ ID NO: 53681

SEQ ID NO: 53684 - protein, 192 aa, Homo sapiens [sequence omitted]

SEQ ID NO: 53685 - protein, 181 aa, Homo sapiens
MSKLGRAARGLRKPEVGGVIRAIVRAGLAMPGPPLGPVLGQRGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKERCSANVLRNGKISMKDPSGRSSV

SEQ ID NO: 53686 - protein, 166 aa, Homo sapiens
MSKLGRAARGLRKPERGVSINQFCKEFNERTKDIKEGIPLPTKILVKPDRTFEIKIGQPTVSYFLKAAAGIEKGARQTGKEVAGLVTLKHVYEIARIKAQDEAFALQDVPLSSVVRSIIGSARSLGIRVVKDLSSEELAAFQKERAIFLAAQKEADLAAQEEAAKK

SEQ ID NO: 53687 - protein, 296 aa, Homo sapiens
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAAAGDEPPPQGGCATFLCQPLDVLKTRLMNSKGEYQGVFHCAVETAKLGPLAFYKGLVPAGIRLIPHTVLTFVFLEQLRKNFGIKVPS

SEQ ID NO: 53688 - protein, 178 aa, Homo sapiens
MLPAAARPLWGPCLGLRAAAFRLARRQVPCVCAVRHMRSSGHQRCEALAGAPLDNAPKEYPPKIQQLVQDIASLTLLEISDLNELLKKTLKIQDVGLVPMGGVMSGAVPAAAAQEAVEEDIPIAKERTHFTVRLTEAKPVDKVKLIKEIKNYIKASTSSRQRSWWSPCPGNQSQCRQS

SEQ ID NO: 53689 - protein, 198 aa, Homo sapiens [sequence omitted]

SEQ ID NO: 53690 - protein, 287 aa, Homo sapiens
MAAEARVSRWYFGGLASCGAACCTHPLDLLKVHLQTQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 53691 - protein, 442 aa, Homo sapiens
MLPAAARPLWGPCLGLRAAAFRLARRQVPCVCAVRHMRSSGHQRCEALAGAPLDNAPKEYPPKIQQLVQDIASLTLLEISDLNELLKKTLKIQDVGLVPMGGVMSGAVPAAAAQEAVEEDIPIAKERTHFTVRLTEAKPVDKVKLIKEIKNYIQGINLVQAKKLVESLPQEIKANVAKAEAEKIKAALEATQQEVKLRMTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 53692 - protein, 244 aa, Homo sapiens
MTGMALRVVRTDGILALYSGLSASLCRQMTYSLTRFAIYETVRDRVAKGSQGPLPFHEKVLLGSVSGLAGGFVGTPADLVNVRMQNDVKLPQGQRRNYAHALDGLYRVAREEGLRRLFSGATMASSRGALVTVGQLSCYDQAKQLVLSTGYLSDNIFTHFVASFIAGGCATFLCQPLDVLKTRLMNSKGEYQGVFHCAVETAKLGPLAFYKGLVPAGIRLIPHTVLTFVFLEQLRKNFGIKVPS

SEQ ID NO: 53693 - protein, 145 aa, Homo sapiens [sequence omitted]

SEQ ID NO: 53694 - protein, 296 aa, Homo sapiens [sequence omitted]

SEQ ID NO: 53695 - protein, 251 aa, Homo sapiens [sequence omitted]

SEQ ID NO: 53696 - protein, 175 aa, Homo sapiens [sequence omitted]

SEQ ID NO: 53697 - protein, 180 aa, Homo sapiens [sequence omitted]

SEQ ID NO: 53698 - protein, 292 aa, Homo sapiens [sequence omitted]

SEQ ID NO: 53699 - protein, 292 aa, Homo sapiens [sequence omitted]

SEQ ID NO: 53700 - protein, 79 aa, Homo sapiens
KVPVNELKVKMKPKPWSKRWERPNFNIKGIRFDLCLTEQQMKEAQKWNQPWLEFDMMREYDTSKIEAAIWKEIEASKRS

SEQ ID NO: 53701 - protein, 305 aa, Homo sapiens [sequence omitted]

SEQ ID NO: 53702 - protein, 149 aa, Homo sapiens
MVFLTAQLWLRNRVTDRYFRIQEVLKHARHFRGRKNRCYRLAVRTVIRAFVKCTKARYLKKKNMRTLWINRITAASQEHGLKYPALIGNLVKCQVELNRKVLADLAIYEPKTFKSLAALASRRRHEGFAAALGDGKEPEGIFSRVVQYH

SEQ ID NO: 53703 - protein, 205 aa, Homo sapiens
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 53704 - protein, 280 aa, Homo sapiens
MAASSLTVTLGRLASACSHSILRPSGPGAASLWSASRRFNSQSTSYLPGYVPKTSLSSPPWPEVVLPDPVEETRHHAEVVKKVNEMIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRSKLEKVPLGPVARCWLPRRMRTEGVGHVGLGTGSPGRSQPGCHCPLATLILEGAPRGSSLAPLLLHAPRVTPPRSPSPPRSARDPTSLPFSSTLRA

SEQ ID NO: 53705 - protein, 120 aa, Homo sapiens
MIVTGQYGRLFAVVHFASRQWKVTSEDLILIGNELDLACGERIRLEKVLLVGADNFTLLGKPLLGKDLVRVEATVIEKTESWPRIIMRFRKRKNFKKKRIVTTPQTVLRINSIEIAPCLL

SEQ ID NO: 53706 - protein, 126 aa, Homo sapiens
MWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 53707 - protein, 232 aa, Homo sapiens
MAAAVLGQLGKDFLVVKRQKGVEMESELTACVDVAGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 53708 - protein, 212 aa, Homo sapiens
MAAAVLGQLGALWIHNLRSRGKLALGLLSFHSVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 53709 - protein, 206 aa, Homo sapiens
MAAAVLGQLGALWIHNLRSRGKLALGVLPQSYIHTSASLDISRKWEKKNKIVYPPQLPGEPRRPAEIYHCRRQIKYSKDKMWYLAKLIRGMSIDQALAQLEFNDKKGAKIIKEVLLEAQDMAVRDHNVEFRSNLYIAESTSGRGQCLKRIRYHGRGRFGIMEKVYCHYFVKLVEGPPPPPEPPKTAVAHAKEYIQQLRSRTIVHTL

SEQ ID NO: 53710 - protein, 153 aa, Homo sapiens
MARNVVYPLYRLGGPQLRVFRTNFFIQLVRPGVAQPEDTVQFRIPMEMTRVDLRNYLEGIYNVPVAAVRTRVQHGSNKRRDHRNVRIKKPDYKVAYVQLAHGQTFTFPDLFPEKDESPEGSAADDLYSMLEEERQQRQSSDPRRGGVPSWFGL

SEQ ID NO: 53711 - protein, 153 aa, Homo sapiens; identical to SEQ ID NO: 53710

SEQ ID NO: 53712 - protein, 216 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDGPKDTSVEDALERTYVPCLKTLQEEVMEAMGIKETRKYKKVYWY

SEQ ID NO: 53713 - protein, 216 aa, Homo sapiens; identical to SEQ ID NO: 53712

SEQ ID NO: 53714 - protein, 99 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIG

SEQ ID NO: 53715 - protein, 68 aa, Homo sapiens
MRLSALLALASKVTLPPHYRYGMSPPGSVADKRKNPPWIRRRPVVVEPISDEDWYLFCGDTVEILEGK

SEQ ID NO: 53716 - protein, 173 aa, Homo sapiens
MRLSALLALASKVTLPPHYRYGMSPPGSVADKRKNPPWIRRRPVVVEPISDEDWYLFCGDTVEILEGKDAGKQGKVVQVIRQRNWVVVGGLNTHYRYIGKTMDYRGTMIPSEAPLLHRQVKLVDPMDRKPTEIEWRFTEAGERVRVSTRSGRIIPKPEFPRADGIVPETWIDG

SEQ ID NO: 53717 - protein, 148 aa, Homo sapiens
MASVVLALRTRTAVTSLLSPTPATALAVRYASKKSGGSSKNLGGKSSGRRQGIKKMEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 53718 - protein, 94 aa, Homo sapiens
MASVVLALRTRTAVTSLLSPTPATALAVRYASKKSGGSSKNLGGKSSGRRQGIKKMEGHYVHAGNIIATQRHFRWHPGAHVSCSVAAPLFPFLG

SEQ ID NO: 53719 - protein, 93 aa, Homo sapiens
MEGHYVHAGNIIATQRHFRWHPGAHVGVGKNKCLYALEEGIVRYTKEVYVPHPRNTEAVDLITRLPKGAVLYKTFVHVVPAKPEGTFKLVAML

SEQ ID NO: 53720 - protein, 93 aa, Homo sapiens; identical to SEQ ID NO: 53719

SEQ ID NO: 53721 - protein, 256 aa, Homo sapiens
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 53722 - protein, 256 aa, Homo sapiens; identical to SEQ ID NO: 53721

SEQ ID NO: 53723 - protein, 256 aa, Homo sapiens
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKASGEDLCSKFGMDLKRGMLLRLARQDPQLHPEDPERRAAIYDKYKEFAIPEEEAEWVGLTLEEAIEKQRLLEEKDPVPLFKIYVAELIQQLQQQALSEPAVVQKRASGQ

SEQ ID NO: 53724 - protein, 256 aa, Homo sapiens; identical to SEQ ID NO: 53723

SEQ ID NO: 53725 - protein, 48 aa, Homo sapiens
MSRAGGRGEQSRWGRRAELRGLGRPEAPLRLGPDVCGSVPCARGAGSE

SEQ ID NO: 53726 - protein, 240 aa, Homo sapiens
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLLEEKDPVPLFKIYVAELIQQLQQ

SEQ ID NO: 53727 - protein, 218 aa, Homo sapiens
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEFAIPEEEAEWVGLTLEEAIEKQRLL

SEQ ID NO: 53728 - protein, 194 aa, Homo sapiens
MPLHKYPVWLWKRLQLREGICSRLPGHYLRSLEEERTPTPVHYRPHGAKFKINPKNGQRERVEDVPIPIYFPPESQRGLWGGEGWILGQIYANNDKLSKRLKKVWKPQLFEREFYSEILDKKFTVTVTMRTLDLIDEAYGLDFYILKTPKEDLCSKFGMDLKRGMLLRLARQDPQLHPEDPERRAAIYDKYKEF

SEQ ID NO: 53729 - protein, 348 aa, Homo sapiens [sequence omitted]

SEQ ID NO: 53730 - protein, 375 aa, Homo sapiens
MPGWRLLTQVGAQVLGRLGDGLGAALGPGNRVTTNSLNVSLIRRNVGSEEKVGDLKKRTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 53731 - protein, 363 aa, Homo sapiens
  MOD_RES (1)..(1): Any amino acid
XFFPSQRASAGDRSGGHCENFPTATASTWRWRGDSLKAERQGARKSTHIWLFVRGLHGKSGTWWDEHLSEENVPFIKQLVSDEDKAQLASKLCPLKDEPWPIHPWEPGSFRVGLIALKLGMMPLWTKDGQKHVVTLLQVQDCHVLKYTSKENCNGKMATLSVGGKTVSRFRKATSILEFYRELGLPPKQTVKIFNITDNAAIKPGTPLYAAHFRPGQYVDVTAKTIGKGFQGVMKRWGFKGQPATHGQTKTHRRPGAVATGDIGRVWPGTKMPGKMGNIYRTEYGLKVWRINTKHNIIYVNGSVPGHKNCLVKVKDSKLPAYKDLGKNLPFPTYFPDGDEEELPEDLYDENVCQPGAPSITFA

SEQ ID NO: 53732 - protein, 161 aa, Homo sapiens
MAGILRLVVQWPPGRLQTVTKGVESLICTDWIRHKFTRSRIPEKVFQASPEDHEKYGGDPQNPHKLHIVTRIKSTRRRPYWEKDIIKMLGLEKAHTPQVHKNIPSVNAKLKVVKHLIRIKPLKLPQGLPAEENMSNTCLKSTGELVVQWHLKPVEQKAHES

SEQ ID NO: 53733 - protein, 161 aa, Homo sapiens; identical to SEQ ID NO: 53732

SEQ ID NO: 53734 - protein, 188 aa, Homo sapiens [sequence omitted]

SEQ ID NO: 53735 - protein, 107 aa, Homo sapiens
MALAMLVLVVSPWSAARGVLRNYWERLLRKLPQSRPGFPSPPWGPALAVQGPAMFTEPANDTSGSKENSSLLDSIFWMAAPKNRRTIEVNRCRRRNPQKLIKVKVMH

SEQ ID NO: 53736 - protein, 92 aa, Homo sapiens [sequence omitted]

SEQ ID NO: 53737 - protein, 170 aa, Homo sapiens
MAASAFAGAVRAASGILRPLNILASSTYRNCVKNASLISALSTGRFSHIQTPVVSSTPRLTTSERNLTCGHTSVILNRMAPVLPSVLKLPVRSLTYFSARKGKRKTVKAVIDRFLRLHCGLWVRRKAGYKKKLWKKTPARKKRLREFVFCNKTQSKLLDKMTTSFWKRRN

SEQ ID NO: 53738 - protein, 188 aa, Homo sapiens [sequence omitted]

SEQ ID NO: 53739 - protein, 103 aa, Homo sapiens [sequence omitted]

SEQ ID NO: 53740 - protein, 103 aa, Homo sapiens [sequence omitted]

SEQ ID NO: 53741 - protein, 103 aa, Homo sapiens [sequence omitted]

SEQ ID NO: 53742 - protein, 103 aa, Homo sapiens [sequence omitted]

SEQ ID NO: 53743 - protein, 416 aa, Homo sapiens
MHFVPWLARPIFPPWDRGYKDPRFYRSPPLHEHPLYKDQACYIFHHRCRLLEGVKQALWLTKTKLIEGLPEKVLSLVDDPRNHIENQDECVLNVISHARLWQTTEEIPKRETYCPVIVDNLIQLCKSQILKHPSLARRICVQNSTFSATWNRESLLLQVRGSGGARLSTKDPLPTIASREEIEATKNHVLETFYPISPIIDLHECNIYDVKNDTGFQEGYPYPYPHTLYLLDKANLRPHRLQPDQLRAKMILFAFGSALAQARLLYGNDAKVLEQPVVVQSVGTDGRVFHFLVFQLNTTDLDCNEGVKNLAWVDSDQLLYQHFWCLPVIKKRVVVTGPCFSKSQMSTSFVLTPSFNAGEEVMQRNLRASASLPPSTGSPASELVKEQEHAAGRVLRRVMLDSETPREELPAADFWK

SEQ ID NO: 53744 - protein, 292 aa, Homo sapiens
MSGACAPRGSRSLLPWIGCTRSLDWSPSPLRGRCTSCPGWRGRSFRPGTAATRTQGSTARPLFTSIRCTKTRPAISFTTVAAFSRSLLLQVRGSGGARLSTKDPLPTIASREEIEATKNHVLETFYPISPIIDLHECNIYDVKNDTGFQEGYPYPYPHTLYLLDKANLRPHRLQPDQLRAKMILFAFGSALAQARLLYGNDAKVLEQPVVVQSVGTDGRVFHFLVFQLNTTDLDCNEGVKNLAWVDSDQLLYQHFWCLPVIKKRVVVEPVGPVGFKPETFRKFLALYLHGAA

SEQ ID NO: 53745 - protein, 423 aa, Homo sapiens [sequence omitted]

SEQ ID NO: 53746 - protein, 264 aa, Homo sapiens
  MOD_RES (1)..(1): Any amino acid
XSLLLQVRGSGGARLSTKDPLPTIASREEIEATKNHVLETFYPISPIIDLHECNIYDVKNDTGFQEGYPYPYPHTLYLLDKANLRPHRLQPDQLRAKMILFAFGSALAQARLLYGNDAKVLEQPVVVQSVGTDGRVFHFLVFQLNTTDLDCNEGVKNLAWVDSDQLLYQHFWCLPVIKKRVVVTGPCFSKSQMSTSFVLTPSFNAGEEVMQRNLRASASLPPSTGSPASELVKEQEHAAGRVLRRVMLDSETPREELPAADFWK

SEQ ID NO: 53747 - protein, 380 aa, Homo sapiens [sequence omitted]

SEQ ID NO: 53748 - protein, 196 aa, Homo sapiens
MPVYCGNEVTPTEAAQAPEVTYEAEEGSLWTLLLTSLDGHLLEPDAEYLHWLLTNIPGNRVAEGQVTCPYLPPFPARGSGIHRLAFLLFKQDQPIDFSEDARPSPCYQLAQRTFRTFDFYKKHQETMTPAGLSFFQCRWDDSVTYIFHQLLDMREPVFEFVRPPPYHPKQKRFPHRQPLRYLDRYRDSHEPTYGIY

SEQ ID NO: 53749 - protein, 353 aa, Homo sapiens
MEALAMGSRALRLWLVAPGGGIKWRFIATSSASQLSPTELTEMRNDLFNKEKARQLSLTPRTEKIEVKHVGKTDPGTVFVMNKNISTPYSCAMHLSEWYCRKSILALVDGQPWDMYKPLTKSCEIKFLTFKDCDPGEVNKAYWRSCAMMMGCVIERAFKDEYMVNLVRAPEVPVISGAFCYDVVLDSKLDEWMPTKENLRSFTKDAHALIYKDLPFETLEVEAKVALEIFQHSKYKVDFIEEKASQNPERIVKLHRIGDFIDVSEGPLIPRTSICFQYEVSAVHNLQPTQPSLIRRFQGVSLPVHLRAHFTIWDKLLERSRKMTPFPILLLFTTQSFFTTSPESYLLHGTVSE

SEQ ID NO: 53750 - protein, 338 aa, Homo sapiens [sequence omitted]

SEQ ID NO: 53751 - protein, 311 aa, Homo sapiens [sequence omitted]

SEQ ID NO: 53752 - protein, 311 aa, Homo sapiens [sequence omitted]

SEQ ID NO: 53753 - protein, 263 aa, Homo sapiens
MLQFVRAGARAWLRPTGSQGLSSLAEEAARATENPEQVASEGLPEPVLRKVELPVPTHRRPVQAWVESLRGFEQERVGLADLHPDVFATAPRLDILHQVAMWQKNFKRISYAKTKTRAEVRGGGRKPWPQKGTGRARHGSIRSPLWRGGGVAHGPRGPTSYYYMLPMKVRALGLKVALTVKLAQDDLHIMDSLELPTGDPQYLTELAHYRRWGDSVLLVDLTHEEMPQSIVEATSRLKTFNLIPAVGEQRAQAPRVRMCRLRC

SEQ ID NO: 53754 - protein, 263 aa, Homo sapiens; identical to SEQ ID NO: 53753

SEQ ID NO: 53755 - protein, 137 aa, Homo sapiens [sequence omitted]

SEQ ID NO: 53756 - protein, 142 aa, Homo sapiens
MGDVKENYLETFISSPKFGRTCADGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNPPKDR

SEQ ID NO: 53757 - protein, 142 aa, Homo sapiens
MAVAAVKWVMSKRTILKHLFPVQNGALYCVCHKSTYSPLPDDYNCNVELALTSDGRTIVCYHPSVDIPYEHTKPIPRPDPVHNNEETHDQVLKTRLEEKVEHLEEGPMIEQLSKMFFTTKHRWYPHGRYHRCRKNLNPPKDR

SEQ ID NO: 53758 - protein, 142 aa, Homo sapiens; identical to SEQ ID NO: 53757

SEQ ID NO: 53759 - protein, 142 aa, Homo sapiens; identical to SEQ ID NO: 53757

SEQ ID NO: 53760 - protein, 202 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPISVQSSDLPWGNTHYRPEPLSSTTWL

SEQ ID NO: 53761 - protein, 215 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPPDLPTVDPISSSLTSAPAPMLSAVSCLPIVPALTTVCSA

SEQ ID NO: 53762 - protein, 159 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQVQAQ

SEQ ID NO: 53763 - protein, 235 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWYSIVALPQKHIAIAIHPPQPAGQCHQAIGHWPETVCSCTADPPARLARPNISSVIRSSLGKYPLPS

SEQ ID NO: 53764 - protein, 164 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQCLLLGAVTL

SEQ ID NO: 53765 - protein, 159 aa, Homo sapiens; identical to SEQ ID NO: 53762

SEQ ID NO: 53766 - protein, 184 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDTGLRLSAVAPQILLPGWPDPTRATRATR

SEQ ID NO: 53767 - protein, 261 aa, Homo sapiens
MTARGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWYSIVALPQKHIAIAIHPPQPAGQCHQAIGHWPETVCSCTADPPARLARPTRPPHSGSYLILIDLCSSPYAVRSFLPPDCPCTDHCVLSVKAA

SEQ ID NO: 53768 - protein, 169 aa, Homo sapiens
  MOD_RES (1)..(1): Any amino acid
XGTPSRFLASVLHNGLGRYVQQLQRLSFSVSRDGASSRGAREFVEREVIDFARRNPGVVIYVNSRPCCVPRVVAEYLNGAVREESIHCKSVEEISTLVQKLADQSGLDVIRIRKPFHTDNPSIQGQWHPFTNKPTTFRGLRPREVQDPAPAQDAAEFLGEGAGPCWTLA

SEQ ID NO: 53769 - protein, 332 aa, Homo sapiens
MASGLVRLLQQGHRCLLAPVAPKLVPPVRGVKKGFRAAFRFQKELERQRLLRCPPPPVRRSEKPNWDYHAEIQAFGHRLQENFSLDLLKTAFVNSCYIKSEEAKRQQLGIEKEAVLLNLKSNQELSEQGTSFSQTCLTQFLEDEYPDMPTEGIKNLVDFLTGEEVVCHVARNLAVEQLTLSEEFPVPPAVLQQTFFAVIGALLQSSGPERTALFIRDFLITQMTGKELFEMWKIINPMGLLVEELKKRNVSAPESRLTRQSGGTTALPLYFVGLYCDKKLIAEGPGETVLVAEEEAARVALRKLYGFTENRRPWNYSKPKETLRAEKSITAS

SEQ ID NO: 53770 - protein, 306 aa, Homo sapiens [sequence omitted]

SEQ ID NO: 53771 - protein, 230 aa, Homo sapiens
MAAAGLALLCRRVSSALKSSRSLITPQVPACTGLLHTTLSRKGLEEFFDDPKNWGQEKVKSGAAWTCQQLRNKSNEDLHKLWYVLLKERNMLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 53772 - protein, 140 aa, Homo sapiens
MLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 53773 - protein, 250 aa, Homo sapiens
MAAAGLALLCRRVSSALKSSRSLITPQVPACTGFFLSLLPKSTPNVTSFHQYRLLHTTLSRKGLEEFFDDPKNWGQEKVKSGAAWTCQQLRNKSNEDLHKLWYVLLKERNMLLTLEQEAKRQRLPMPSPERLDKVVDSMDALDKVVQEREDALRLLQTGQERARPGAWRRDIFGRIIWHKFKQWVIPWHLNKRYNRKRFFALPYVDHFLRLEREKRARIKARKENLERKKAKILLKKFPHLAEAQKSSLV

SEQ ID NO: 53774 - protein, 212 aa, Homo sapiens [sequence omitted]

SEQ ID NO: 53775 - protein, 194 aa, Homo sapiens
MGLSSCRKTSSGLPLILHYGGILLSISRPYKTKPTHGIGKYKHLIKAEEPKKKKGKVEVRAINLGTDYEYGVLNIHLTAYDMTLAESYAQYVHNLCNSLSIKVEESYAMPTKTIEVLQLQDQGSKMLLDSVLTTHERVVQISGLSATFAEIFLEIIQSSLPEGVRLSVKEHTEEDFKGRFKARPELEELLAKLK

SEQ ID NO: 53776 - protein, 166 aa, Homo sapiens
MAATMFRATLRGWRTGVQRGCGLRLLSQTQGPPDYPRFVESVDEYQFVERLLPATRIPDPPKHEHYPTPSGWQPPRDPPPNLPYFVRRSRMHNIPVYKDITHGNRQMTVIRKVEGDIWALQKDVEDFLSPLLGKTPVTQVNEVTGTLRIKGYFDQELKAWLLEKGF

SEQ ID NO: 53777 - protein, 166 aa, Homo sapiens; identical to SEQ ID NO: 53776

SEQ ID NO: 53778 - protein, 158 aa, Homo sapiens
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRVRDVLDFYNVPIQDRSKFDELSASNLPPNLKITWSY

SEQ ID NO: 53779 - protein, 135 aa, Homo sapiens
MAARSVSGITRRVFMWTVSGTPCREFWSRFRKEKEPVVVETVEEKKEPILVCPPLRSRAYTPPEDLQSRLESYVKEVFGSSLPSNWQDISLEDSRLKFNLLAHLADDLGHVVPNSRLHQMCRGYSFEEGKIQLGI

SEQ ID NO: 53780 - protein, 128 aa, Homo sapiens
MAGNLLSGAGRRLWDWVPLACRSFSLGVPRLIGIRLTLPPPKVVDRWNEKRAMFGVYDNIGILGNFEKHPKELIRGPIWLRGWKGNELQRCIRKRKMVGSRMFADDLHNLNKRIRYLYKHFNRHGKFR

SEQ ID NO: 53781 - protein, 123 aa, Homo sapiens
MAALGTVLFTGVRRLHCSVAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 53782 - protein, 122 aa, Homo sapiens
MAALGTVLFSVRRLHCSVAAWAGGQWRLQQGLAANPSGYGPLTELPDWSYADGRPAPPMKGQLRRKAERETFARRVVLLSQEMDAGLQAWQLRQQKLQEEQRKQENALKPKGASLKSPLPSQ

SEQ ID NO: 53783 - protein, 87 aa, Homo sapiens
MAALGTVLFTGVRRLHCSVAAWAGGQWRLQQGLAANPSGYGPLTELPDWSYAETSCTAVTGNGRWITSMAAQAAEVAGRTKEAGKCS

SEQ ID NO: 53784 - protein, 64 aa, Homo sapiens
MKGQLRRKAERETFARRVVLLSQEMDAGLQAWQLRQQKLQEEQRKQENALKPKGASLKSPLPSQ

SEQ ID NO: 53785 - protein, 64 aa, Homo sapiens; identical to SEQ ID NO: 53784

SEQ ID NO: 53786 - protein, 64 aa, Homo sapiens; identical to SEQ ID NO: 53784

SEQ ID NO: 53787 - protein, 112 aa, Homo sapiens
MAAALARLGLRPVKQVRVQFCPFEKNVESTRTFLQTVSSEKVRSTNLNCSVIADVRHDGSEPCVDVLFGDGHRLIMRGAHLTALEMLTAFASHIRARDAAGSGDKPGADTGR

SEQ ID NO: 53788 - protein, 138 aa, Homo sapiens
MATKRLFGATRTWAGWGAWELLNPATSGRLLARDYAKKPVMKGAKSGKGAVTSEALKDPDVCTDPVQLTTYAMGVNIYKEGQDVPLKPDAEYPEWLFEMNLGPPKTLEELDPESREYWRRLRKQNIWRHNRLSKNKRL

SEQ ID NO: 53789 - protein, 128 aa, Homo sapiens
MAAVGSLLGRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 53790 - protein, 128 aa, Homo sapiens; identical to SEQ ID NO: 53789

SEQ ID NO: 53791 - protein, 128 aa, Homo sapiens; identical to SEQ ID NO: 53789

SEQ ID NO: 53792 - protein, 128 aa, Homo sapiens; identical to SEQ ID NO: 53789

SEQ ID NO: 53793 - protein, 164 aa, Homo sapiens
MAAVGSLLGLAASSWLGGQNASDHSLWLLRKPRGSSCPGTGHQLCRLRQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 53794 - protein, 125 aa, Homo sapiens
MAAVGSLLGQSTVKATGPALRRLHTSSWRADSSRASLTRVHRQAYARLYPVLLVKQDGSTIHIRYREPRRMLAMPIDLDTLSPEERRARLRKREAQLQSRKEYEQELSDDLHVERYRQFWTRTKK

SEQ ID NO: 53795 - protein, 128 aa, Homo sapiens; identical to SEQ ID NO: 53789

SEQ ID NO: 53796 - protein, 128 aa, Homo sapiens; identical to SEQ ID NO: 53789

SEQ ID NO: 53797 - protein, 128 aa, Homo sapiens; identical to SEQ ID NO: 53789

SEQ ID NO: 53798 - protein, 128 aa, Homo sapiens; identical to SEQ ID NO: 53789

SEQ ID NO: 53799 - protein, 164 aa, Homo sapiens; identical to SEQ ID NO: 53793

SEQ ID NO: 53800 - protein, 128 aa, Homo sapiens; identical to SEQ ID NO: 53789

SEQ ID NO: 53801 - protein, 128 aa, Homo sapiens; identical to SEQ ID NO: 53789

SEQ ID NO: 53802 - protein, 128 aa, Homo sapiens; identical to SEQ ID NO: 53789

SEQ ID NO: 53803 - protein, 128 aa, Homo sapiens; identical to SEQ ID NO: 53789

SEQ ID NO: 53804 - protein, 128 aa, Homo sapiens; identical to SEQ ID NO: 53789

SEQ ID NO: 53805 - protein, 128 aa, Homo sapiens; identical to SEQ ID NO: 53789

SEQ ID NO: 53806 - protein, 128 aa, Homo sapiens; identical to SEQ ID NO: 53789

SEQ ID NO: 53807 - protein, 128 aa, Homo sapiens; identical to SEQ ID NO: 53789

SEQ ID NO: 53808 - protein, 128 aa, Homo sapiens; identical to SEQ ID NO: 53789

SEQ ID NO: 53809 - protein, 164 aa, Homo sapiens; identical to SEQ ID NO: 53793

SEQ ID NO: 53810 - protein, 76 aa, Homo sapiens
MAAVGSLLGRLRQSTVKATGPALRRLHTSSWRADSSRASLTRVHRQAYARLYPVLLVKQDGSTIHIRYREPRRMLA

SEQ ID NO: 53811 - protein, 233 aa, Homo sapiens
MAAPVVTAPGRALLRAGAGRLLRGGVQELLRPRHEGNAPDLACNFSLSQNRGTVIVERWWKVPLAGEGRKPRLHRRHRVYKLVEDTKHRPKENLELILTQSVENVGVRGDLVSVKKSLGRNRLLPQGLAVYASPENKKLFEEEKLLRQEGKLEKIQTKAGEALGVVVAPHTLKLPEEPITRWGEYWCEVTVNGLDTVRVPMSVVNFEKPKTKRYKYWLAQQAAKAMAPTSPQI

SEQ ID NO: 53812 - protein, 267 aa, Homo sapiens [sequence omitted]

SEQ ID NO: 53813 - protein, 201 aa, Homo sapiens
MAARTAFGAVCRRLWQGLGNFSVNTSKGNTAKNGGLLLSTNMKWVQFSNLHVDVPKDLTKPVVTISDEPDILYKRLSVLVKGHDKAVLDSYEYFAVLAAKELGISIKVHEPPRKIERFTLLQSVHIYKKHRVQYEMRTLYRCLELEHLTGSTADVYLEYIQRNLPEGVAMEVTKTQLEQLPEHIKEPIWETLSEEKEESKS

SEQ ID NO: 53814 - protein, 194 aa, Homo sapiens
MQAVRNAGSRFLRSWTWPQTAGRVVARTPAGTICTGARQLQDAAAKQKVEQNAAPSHTKFSIYPPIPGEESSLRWAGKKFEEIPIAHIKASHNNTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 53815 - protein, 161 aa, Homo sapiens
MQAVRNAGSRFLRSWTWPQTAGRVVARTPAGTICTGARQLQDAAAKQKVEQNAAPSHTKFSTQIQVVSASNEPLAFASCGTEGFRNAKKGTGIAAQTAGIAAAARAKQKGVIHIRVVVKGLGPGRLSAMHGLIMGGLEVISITDNTPIPHNGCRPRKARKL

SEQ ID NO: 53816 - protein, 138 aa, Homo sapiens
MSWSGLLHGLNTSLTCGPALVPRLWATCSMATLNQMHRLGPPKRPPRKLGPTEGRPQLKGVVLCTFTRKPKKPNSANRKCCRVRLSTGREAVCFIPGEGHTLQEHQIVLVEGGRTQDLPGVKLTVVRGKYDCGHVQKK

SEQ ID NO: 53817 - protein, 138 aa, Homo sapiens; identical to SEQ ID NO: 53816

SEQ ID NO: 53818 - protein, 138 aa, Homo sapiens; identical to SEQ ID NO: 53816

SEQ ID NO: 53819 - protein, 128 aa, Homo sapiens
MAAFMLGSLLRTFKQMVPSSASGQVRSHYVDWRMWRDVKRRKMAYEYADERLRINSLRKNTILPKILQDVADEEIAALPRDSCPVRIRNRCVMTSRPRGVKRRWRLSRIVFRHLADHGQLSGIQRATW

SEQ ID NO: 53820 - protein, 257 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKDSQ

SEQ ID NO: 53821 - protein, 99 aa, Homo sapiens
MVHLTTLLCKAYRGGHLTIRLALGGCTNRPFYRIVAAHNKCPRDGRFVEQLGSYDPLPNSHGEKLVALNLDRIRHWIGCGAHLSKPMEKLLGLKYSHVF

SEQ ID NO: 53822 - protein, 137 aa, Homo sapiens
MVHLTTLLCKAYRGGHLTIRLALGGCTNRPFYRIVAAHNKCPRDGRFVEQLGSYDPLPNSHGEKLVALNLDRIRHWIGCGAHLSKPMEKLLGLAGFFPLHPMMITNAERLRRKRAREVLLASQKTDAEATDTEATET

SEQ ID NO: 53823 - protein, 123 aa, Homo sapiens
MVHLTTLLCKAYRGGHLTIRLALGGCTNRPFYRIVAAHNKCPRDGRFVEQLGSYDPLPNSHGEKLVALNLDRIRHWIGCGAHLSKPMEKLLGKTDARFPEQGEERPEQHHFPEDLAPARGRGL

SEQ ID NO: 53824 - protein, 130 aa, Homo sapiens
MSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSAQ

SEQ ID NO: 53825 - protein, 129 aa, Homo sapiens
MSVVRSSVHARWIVGKVIGTKMQKTAKVRVTRLVLDPYLLKYFNKRKTYFAHDALQQCTVGDIVLLRALPVPRAKHVKHELAEIVFKVGKVIDPVTGKPCAGTTYLESPLSSETTQLSKNLEELNISSA

SEQ ID NO: 53826 - protein, 127 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGT

SEQ ID NO: 53827 - protein, 270 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGRRPWGPRGAEGCRHSLPTQLPHVSAPPGRKVDIRSVNYTHHPMPTFPLPWAFPLAPSELQRELQRLSPLPRHSGLLPNHRPRLPEGVVPKSKPQLNRYLTRWAPGSVKPIYKKGPRWNRVRMPVGSPLLRDNVCYSRTPWKLYH

SEQ ID NO: 53828 - protein, 196 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGLLPNHRPRLPEGVVPKSKPQLNRYLTRWAPGSVKPIYKKGPRWNRVRMPVGSPLLRDNVCYSRTPWKLYH

SEQ ID NO: 53829 - protein, 264 aa, Homo sapiens
MAALKALVSGCGRLLRGLLAGPAATSWSRLPARGFREVVETQEGKTTIIEGRITATPKESPNPPNPSGQCPICRWNLKHKYNYDDVLLLSQFIRPHGGMLPRKITGLCQEEHRKIEECVKMAHRAGRRPWGPRGAEGCRHSLPTQLPHVSAPPGRKVDIRSVNYTHHPMPTFPLPWAFPLAPSELQRELQRLSPLPRHSGLLPNHRPRLPEGVVPKSKPQLNRYLTRWAPGSVKPIYKKGPRWNRVRMPVGSPLLRDNVCYSRT

SEQ ID NO: 53830 - protein, 258 aa, Homo sapiens
MAASVLNTVLRRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRNVKLLEQFVCAHTGIIFYAPYTGVCVKQHKRLTQAIQKARDHGLLIYHIPQVEPRDLDFSTSHGAVSATPPAPTLVSGDPWYPWYNWKQPPERELSRLRRLYQGHLQEESGPPPESMPKMPPRTPAEASSTGQTGPQSAL

SEQ ID NO: 53831 - protein, 258 aa, Homo sapiens; identical to SEQ ID NO: 53830

SEQ ID NO: 53832 - protein, 215 aa, Homo sapiens
MAASVLNTVLRRLPMLSLFRGSHRVQVPLQTLCTKAPSEEDSLSSVPISPYKDEPWKYLESEEYQERYGSRPVWADYRRNHKGGVPPQRTRKTCINVKLLEQFVCAHTGIIFYAPYTGLLIYHIPQVEPRDLDFSTSHGAVSATPPAPTLVSGDPWYPWYNWKQPPERELSRLRRLYQGHLQEESGPPPESMPKMPPRTPAEASSTGQTGPQSAL

SEQ ID NO: 53833 - protein, 215 aa, Homo sapiens; identical to SEQ ID NO: 53832

SEQ ID NO: 53834 - protein, 258 aa, Homo sapiens; identical to SEQ ID NO: 53830

SEQ ID NO: 53835 - protein, 215 aa, Homo sapiens; identical to SEQ ID NO: 53832

SEQ ID NO: 53836 - protein, 215 aa, Homo sapiens; identical to SEQ ID NO: 53832

SEQ ID NO: 53837 - protein, 258 aa, Homo sapiens; identical to SEQ ID NO: 53830

SEQ ID NO: 53838 - protein, 215 aa, Homo sapiens; identical to SEQ ID NO: 53832

SEQ ID NO: 53839 - protein, 258 aa, Homo sapiens; identical to SEQ ID NO: 53830

SEQ ID NO: 53840 - protein, 215 aa, Homo sapiens; identical to SEQ ID NO: 53832

SEQ ID NO: 53841 - protein, 215 aa, Homo sapiens; identical to SEQ ID NO: 53832

SEQ ID NO: 53842 - protein, 258 aa, Homo sapiens; identical to SEQ ID NO: 53830

SEQ ID NO: 53843 - protein, 258 aa, Homo sapiens; identical to SEQ ID NO: 53830

SEQ ID NO: 53844 - protein, 121 aa, Homo sapiens
MAASVLNTVLRRLPMLSLFRGSHRVQVPLQTLCTKAPSEEDSLSSVPISPYKDEPWKYLESEEYQERYGSRPVWADYRRNHKGGVPPQRTRKTCIRRNKVVGNPCPICRDHKLHVDFRESV

SEQ ID NO: 53845 - protein, 121 aa, Homo sapiens; identical to SEQ ID NO: 53844

SEQ ID NO: 53846 - protein, 121 aa, Homo sapiens; identical to SEQ ID NO: 53844

SEQ ID NO: 53847 - protein, 121 aa, Homo sapiens; identical to SEQ ID NO: 53844

SEQ ID NO: 53848 - protein, 121 aa, Homo sapiens; identical to SEQ ID NO: 53844

SEQ ID NO: 53849 - protein, 121 aa, Homo sapiens; identical to SEQ ID NO: 53844

SEQ ID NO: 53850 - protein, 121 aa, Homo sapiens; identical to SEQ ID NO: 53844

SEQ ID NO: 53851 - protein, 142 aa, Homo sapiens
MAAVVAVCGGLGRKKLTHLVTAAVSLTHPGTHTVLWRRGCSQQVSSNEDLPISMENPYKEPLKKCILCGKHVDYKNVQLLSQFVSPFTGCIYGRHITGLCGKKQKEITKAIKRAQIMGFMPVTYKDPAYLKDPKVCNIRYRE

SEQ ID NO: 53852 - protein, 114 aa, Homo sapiens
MAAVVAVCGGLGRKKLTHLVTAAVSLTHPGTHTVLWRRGCSQQVSSNEDLLLSQFVSPFTGCIYGRHITGLCGKKQKEITKAIKRAQIMGFMPVTYKDPAYLKDPKVCNIRYRE

SEQ ID NO: 53853 - protein, 296 aa, Homo sapiens
MATSSAALPRILGAGARAPSRWLGFLGKATPRPARPSRRTLGSATALMIRESEDSTDFNDKILNEPLKHSDFFNVKELFSVRSLFDARVHLGHKAGCRHRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTAITRAKEKRQQVEALYRLQGQKEPGDQGPAHPPGADMSHSL

SEQ ID NO: 53854 - protein, 296 aa, Homo sapiens; identical to SEQ ID NO: 53853

SEQ ID NO: 53855 - protein, 270 aa, Homo sapiens
RRGPLGMRWGAGVVHSGLGARTSIYFPPGARAPSRWLGFLGKATPRPARPSRRTLGSATALMIRESEDSTDFNDKILNEPLKHSDFFNVKELFSVRSLFDARVHLGHKAGCRHRFMEPYIFGSRLDHDIIDLEQTATHLQLALNFTAHMAYRKGIILFISRNRQFSYLIENMARDCGEYAHTRYFRGGMLTNARLLFGPTVRLPDLIIFLHTLNNIFEPHVAVRDAAKMNIPTVGIVDTNCNPCLITYPVPGNDDSPLAVHLYCRLFQTA

SEQ ID NO: 53856 - protein, 87 aa, Homo sapiens
MAKHLKFIARTVMVQEGNVESAYRTLNRILTMDGLIEDIKHRRYYEKPCRRRQRESYERCRRIYNMEMARKINFLMRKNRADPWQGC

SEQ ID NO: 53857 - protein, 87 aa, Homo sapiens; identical to SEQ ID NO: 53856

SEQ ID NO: 53858 - protein, 360 aa, Homo sapiens
MAPLGTTVLLWSLLRSSPGVERVCFRARIQPWHGGLLQPLPCSFEMGLPRRRFSSEAAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 53859 - protein, 359 aa, Homo sapiens
MAPLGTTVLLWSLLRSSPGVERVCFRARIQPWHGGLLQPLPCSFEMGLPRRRFSSEAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 53860 - protein, 319 aa, Homo sapiens
MSRNETEHRYLGTHFGAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRERFIVVREPSGTLRKASWEERDRMIQVYFPKEGRKILTPIIFKEENLRTMYSQDRHVDVLNLCFAQFEPDSTEYIKVHHKTYEDIDKRGKYDLLRSTRYFGGMVWYFVNNKKIDGLLIDQIQRDLIDDATNLVQLYHVLHPDGQSAQGAKDQAAEGINLIKVFAKTEAQKGAYIELTLQTYQEALSRHSAAS

SEQ ID NO: 53861 - protein, 360 aa, Homo sapiens; identical to SEQ ID NO: 53858

SEQ ID NO: 53862 - protein, 168 aa, Homo sapiens
MAPLGTTVLLWSLLRSSPGVERVCFRARIQPWHGGLLQPLPCSFEMGLPRRRFSSEAESGSPETKKPTFMDEEVQSILTKMTGLNLQKTFKPAIQELKPPTYKLMTQAQLEEATRQAVEAAKVRLKMPPVLEERVPINDVLAEDKILEGTETTKYVFTDISYSIPHRC

SEQ ID NO: 53863 - protein, 190 aa, Homo sapiens
MAGSRLETVGSIFSRTRDLVRAGVLKEKPLWFDVYDAFPPLREPVFQRPRVRYGKAKAPIQDIWYHEDRIRAKFYSVYGSGQRAFDLFNPNFKSTCQRFVEKYTELQKLGETDEEKLFVETGKALLAEGVILRRVGEARTQHGGSHVSRKSEHLSVRPQTALEENETQKEVPQDQHLEAPADQSKGLLPP

SEQ ID NO: 53864 - protein, 167 aa, Homo sapiens
MAASVCSGLLGPRVLSWSRELPCAWRALHTSPVCAKNRAARVRVSKGDKPVTYEEAHAPHYIAHRKGWLSLHTGNLDGEDHAAERTVEDVFLRKFMWGTFPGCLADQLVLKRRGNQLEICAVVLRQLSPHKYYFLVGYSETLLSYFYKCPVRLHLQTVPSKVVYKYL

SEQ ID NO: 53865 - protein, 173 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNEETLREEEEEKKQLSHPANFGPRKYCLRECICEVEGQVPCPSLVPLPKEMRGKYKAALKADAQD

SEQ ID NO: 53866 - protein, 110 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNE

SEQ ID NO: 53867 - protein, 129 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLGKPSGKRRRRKSSFLTQPTSALESTACGSASVKWKGRCPAPAWCHYPRR

SEQ ID NO: 53868 - protein, 110 aa, Homo sapiens; identical to SEQ ID NO: 53866

SEQ ID NO: 53869 - protein, 145 aa, Homo sapiens
MPMKGRFPIRRTLQYLSQGNVVFKDSVKVMTVNYNTHGELGEGARKFVFFNIPQIQYKNPWVQIMMFKNMTPSPFLRFYLDSGEQVLVDVETKSNKEIMEHIRKILGKNEHYLAAPSKPVSSAVVPVTQEAEAGGSLEPRRLRLE

SEQ ID NO: 53870 - protein, 205 aa, Homo sapiens
MLRALSRLGAGTPCRPRAPLVLPARGRKTRHDPLAKSKIERVNMPPAVDPAEFFVLMERYQHYRQTVRALRMEFVSEVQRKVHEARAGVLAERKALKDAAEHRELMAWNQAENRRLHELRIARLRQEEREQEQRQALEQARKAEEVQAWAQRKEREVLQLQEEVKNFITRENLEARVEAALDSRKNYNWAITREGLVVRPQRRDS

SEQ ID NO: 53871 - protein, 414 aa, Homo sapiens
MAASIVRRGMLLARQVVLPQLSPAGKRYLLSSAYVDSHKWEAREKEHYCLADLASLMDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 53872 - protein, 358 aa, Homo sapiens
MDKTFERKLPVSSLTISRLIDNISSREEIDHAEYYLYKFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 53873 - protein, 428 aa, Homo sapiens
MAASIVRRGMLLARQVVLPQLSPAGKRYLLSSAYVDSHKWEAREKEHYCLADLASLMDKTFERKLPVSSLTISRLIDNISSREEIDHAEYYLYKKGECSSSNPQNYSRFRHSPNCWYLRNWTIHTWIRQCLKYDAQDKALYTLVNKVQYGIFPDNFTFNLLMDSFIKKENYKDALSVVFEVMMQEAFEVPSTQLLSLYVLFHCLAKKTDFSWEEERNFGASLLLPGLKQKNSVGFSSQLYGYALLGKVELQQGLRAVYHNMPLIWKPGYLDRALQVMEKVAASPEDIKLCREALDVLGAVLKALTSADGASEEQSQNDEDNQGSEKLVEQLDIEETEQSKLPQYLERFKALHSKLQALGKIESEGLLSLTTQLVKEKLSTCEAEDIATYEQNLQQWHLDLVQLIQREQQQREQAKQEYQAQKAAKASA

SEQ ID NO: 53874 - protein, 187 aa, Homo sapiens
MAALCRTRAVAAESHFLRVFLFFRPFRGVGTESGSESGSSNAKEPKTRAGGFASALERHSELLQKVEPLQKGSPKNVESFASMLRHSPLTQMGPAKDKLVIGRIFHIVENDLYIDFGGKFHCVCRRPEVDGEKYQKGTRVRLRLLDLELTSRFLGATTDTTVLEANAVLLGIQESKDSRSKEEHHEK

SEQ ID NO: 53875 - protein, 439 aa, Homo sapiens
MAAARCWRPLLRGPRLSLHTAANAAATATETTCQDVAATPVARYPPIVASMTADSKAARLRRIERWQATVHAAESVDEKLRILTKMQFMKYMVYPQTFALNADRWYQYFTKTVFLSGLPPPPAEPEPEPEPEPEPALDLAALRAVACDCLLQEHFYLRRRRRVHRYEESEVISLPFLDQLVSTLVGLLSPHNPALAAAALDYRCPVHFYWVRGEEIIPRGHRRGRIDDLRYQIDDKPNNQIRISKQLAEFVPLDYSVPIEIPTIKCKPDKLPLFKRQYENHIFVGSKTADPCCYGHTQFHLLPDKLRRERLLRQNCADQIEVVFRANAIASLFAWTGAQAMYQGFWSEADVTRPFVSQAVITDGKYFSFFCYQLNTLALTTQADQNNPRKNICWGTQSKPLYETIEDNDVKGFNDDVLLQIVHFLLNRPKEEKSQLLEN

SEQ ID NO: 53876 - protein, 395 aa, Homo sapiens
MFPRVSTFLPLRPLSRHPLSSGSPETSAAAIMLLTVRHGTVRYRSSALLARTKNNIQRYFGTNSVICSKKDKQSVRTEETSKETSESQDSEKENTKKDLLGIIKGMKVELSTVNVRTTKPPKRRPLKSLEATLGRLRRATEYAPKKRIEPLSPELVAAASAVADSLPFDKQTTKSELLSQLQQHEEESRAQRDAKRPKISFSNIISDMKVARSATARVRSRPELRIQFDEGYDNYPGQEKTDDLKKRKNIFTGKRLNIFDMMAVTKEAPETDTSPSLWDVEFAKQLATVNEQPLQNGFEELIQWTKEGKLWEFPINNEAGFDDDGSEFHEHIFLEKHLESFPKQGPIRHFMELVTCGLSKNPYLSVKQKVEHIEWFRNYFNEKKDILKESNIQFN

SEQ ID NO: 53877 - protein, 106 aa, Homo sapiens
MSSLSEYAFRMSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRK

SEQ ID NO: 53878 - protein, 106 aa, Homo sapiens; identical to SEQ ID NO: 53877

SEQ ID NO: 53879 - protein, 106 aa, Homo sapiens; identical to SEQ ID NO: 53877

SEQ ID NO: 53880 - protein, 106 aa, Homo sapiens; identical to SEQ ID NO: 53877

SEQ ID NO: 53881 - protein, 112 aa, Homo sapiens
MSSLSEYAFRMSRLSARLFGEVTRPTNSKSMKVVKLFSELPLAKKKETYDWYPNHHTYAELMQTLRFLGLYRDEHQDFMDEQKRLKKLRGKEKPKKGEGKRAAKRKKKKKKR

SEQ ID NO: 53882 - protein, 225 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKDASFSSSGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 53883 - protein, 218 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 53884 - protein, 323 aa, Homo sapiens
MAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVKLSSLNLDDHAKKKLIKLVGERYCKTTDVLTIKTDRCPLRRQNYDYAVYLLTVLYHESWNTEEWEKSKTEADMEEYIWENSSSERNILETLLQMKAAEKNMEINKEELLGTKEIEEYKKSVVSLKNEEENENSISQYKESVKRLLNVT

SEQ ID NO: 53885 - protein, 287 aa, Homo sapiens
MAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRRCPLRRQNYDYAVYLLTVLYHESWNTEEWEKSKTEADMEEYIWENSSSERNILETLLQMKAAEKNMEINKEELLGTKEIEEYKKSVVSLKNEEENENSISQYKESVKRLLNVT

SEQ ID NO: 53886 - protein, 194 aa, Homo sapiens
MAAAALPAWLSLQSRARTLRAFSTAVYSATPVPTPSLPERTPGNERPPRRKALPPRTEKMAVDQDWPSVYPVAAPFKPSAVPLPVRMGYPVKKGVPMAKEGNLELLKIPNFLHLTPVAIKKHCEALKDFCTEWPAALDSDEKCEKHFPIEIDSTDYVSSGPSVRNPRARVVVLRVPFKEAELRLCSVSTNSVIP

SEQ ID NO: 53887 - protein, 103 aa, Homo sapiens
MMGSKMASASRVVQVVKPHTPLIRFPDRRDNPKPNVSEALRSAGLPSHSSVISQHSKGSKSPDLLMYQGPPDTAEIIKTLPQKYRRKLVSQEEMEFIQRGGPE

SEQ ID NO: 53888 - protein, 430 aa, Homo sapiens
MATAVRAVGCLPVLCSGTAGHLLGRQCSLNTLPAASILAWKSVLGNGHLSSLGTRDTHPYASLSRALQTQCCISSPSHLMSQQYRPYSFFTKLTADELWKGALAETGAGAKKGRGKRTKKKKRKDLNRGQIIGEGRYGFLWPGLNVPLMKNGAVQTIAQRSKEEQEKVEADMIQQREEWDRKKKMKVKRERGWSGNSWGGISLGPPDPGPCGETYEDFDTRILEVRNVFTMTAKEGRKKSIRVLVAVGNGKGAAGFSIGKATDRMDAFRKAKNRAVHHLHYIERYEDHTIFHDISLRFKRTHIKMKKQPKGYGLRCHRAIITICRLIGIKDMYAKVSGSINMLSLTQGLFRGLSRQETHQQLADKKGLHVVEIREECGPLPIVVASPRGPLRKDPEPEDEVPDVKLDWEDVKTAQGMKRSVWSNLKRAAT

SEQ ID NO: 53889 - protein, 125 aa, Homo sapiens
MPRYELALILKAMQRPETAATLKRTIEALMDRGAIVRDLENLGERALPYRISAHSQQHNRGGYFLVDFYAPTAAVESMVEHLSRDIDVIRGNIVKHPLTQELKECEGIVPVPLAEKLYSTKKRKK

SEQ ID NO: 53890 - protein, 242 aa, Homo sapiens
MAAPAVKVARGWSGLALGVRRAVLQLPGLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 53891 - protein, 396 aa, Homo sapiens
MAAPCVSYGGAVSYRLLLWGRGSLARKQGLWKTAAPELQTNVRSQILRLRHTAFVIPKKNVPTSKRETYTEDFIKKQIEEFNIGKRHLANMMGEDPETFTQEDIDRAIAYLFPSGLFEKRARPVMKHPEQIFPRQRAIQWGEDGRPFHYLFYTGKQSYYSLMHDVYGMLLNLEKHQSHLQAKSLLPEKTVTRDVIGSRWLIKEELEEMLVEKLSDLDYMQFIRLLEKLLTSQCGAAEEEFVQRFRRSVTLESKKQLIEPVQYDEQGMAFSKSEGKRKTAKAEAIVYKHGSGRIKVNGIDYQLYFPITQDREQLMFPFHFVDRLGKHDVTCTVSGGGRSAQAGAIRLAMAKALCSFVTEDEVEWMRQAGLLTTDPRVRERKKPGQEGARRKFTWKKR

SEQ ID NO: 53892 - protein, 373 aa, Homo sapiens
MWVCSTLWRVRTPARQWRGLLPASGCHGPAASSYSASAEPARVRALVYGHHGDPAKVVELKNLELAAVRGSDVRVKMLAAPINPSDINMIQGNYGFLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 53893 - protein, 297 aa, Homo sapiens
MLAAPINPSDINMIQGNYGFLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKDMPQPRLALNCVGGKSSTELLRQLARGGTMVTYGGMAKQPVVASVSLLIFKDLKLRGFWLSQWKKDHSPDQFKELILTLCDLIRRGQLTAPACSQVPLQDYQSALEASMKPFISSKQILTM

SEQ ID NO: 53894 - protein, 262 aa, Homo sapiens
MIQGNYGFLPELPAVGGNEGVAQVVAVGSNVTGLKPGDWVIPANAGLGTWRTEAVFSEEALIQVPSDIPLQSAATLGVNPCTAYRMLMDFEQLQPGDSVIQNASNSGVGQAVIQIAAALGLRTINVVRDRPDIQKLSDRLKSLGAEHVITEEELRRPEMKNFFKIRKLRLRKEEMLNQNHIVYKGSRESELASVSPNSKPLNLPEPPPHNMPRHAPATACSQLCWWEKLHRAAAAVSAWRNHGNLWGDGQAARRSLCEPAHF

SEQ ID NO: 53895 - protein, 189 aa, Homo sapiens
ATLGVNPCTAYRMLMDFEQLQPGDSVIQNASNSGVGQAVIQIAAALGLRTINVVRDRPDIQKLSDRLKSLGAEHVITEEELRRPEMKNFFKIRKLRLRKEEMLNQNHIVYKGSRESELASVSPNSKPLNLPEPPPHNMPRHAPATACSQLCWWEKLHRAAAAVSAWRNHGNLWGDGQAARRSLCEPAHF

SEQ ID NO: 53896 - protein, 399 aa, Homo sapiens
MQSLSLGQTSISKGLNYLTIMAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVNILERSPESFFRSNNNLNLENNIKFLYSVGLTRKCLCRLLTNAPRTFSNSLDLNKQMVEFLQAAGLSLGHNDPADFVRKIIFKNPFILIQSTKRVKANIEFLRSTFNLNSEELLVLICGPGAEILDLSNDYARRSYANIKEKLFSLGCTEEEVQKFVLSYPDVIFLAEKKFNDKIDCLMEENISISQIIENPRVLDSSISTLKSRIKELVNAGCNLSTLNITLLSWSKKRYEAKLKKLSRFA

SEQ ID NO: 53897 - protein, 158 aa, Homo sapiens
MQSLSLGQTSISKGLNYLTIMAPGNLWHMRNNFLFGSRCWMTRFSAENIFKSVSFRLFGVKCHNTDSEPLKNEDLLKNLLTMGVDIDMARKRQPGVFHRMITNEQDLKMFLLSKGASKEVIASIISRYPRAITRTPENLSKRWDLWRKIVTSDLEIVN

SEQ ID NO: 53898 - protein, 727 aa, Homo sapiens
MNQKLLKLENLLRFHTIYRQLHSLCQRRALRQWRHGFSSAYPVWTAQLCAWPWPTDVLTGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKIIEEKRKEHKEAHQKAREKYGHLLWKKRSILRFLERKEQIPLKPKEKRERDSNVLSVIIKGDVDGSVEAILNIIDTYDASHECELELVHFGVGDVSANDVNLAETFDGVIYGFNVNAGNVIQQSAAKKGVKIKLHKIIYRLVEDLQEELSSRLPCAVEEHPVGEASILATFSVTEGKKKVPVAGCRVQKGQLEKQKKFKLTRNGHVIWKGSLTSLKHHKDDISIVKTGMDCGLSLDEDNMEFQVGDRIVCYEEKQIQAKTSWDPGF

SEQ ID NO: 53899 - protein, 72 aa, Homo sapiens
MNQKLLKLENLLRFHTIYRQLHSLCQRRALRQWRHGFSSAYPVWTAQLCAWPWPTDVLTGAALSQYRLLVTK

SEQ ID NO: 53900 - protein, 727 aa, Homo sapiens; identical to SEQ ID NO: 53898

SEQ ID NO: 53901 - protein, 727 aa, Homo sapiens; identical to SEQ ID NO: 53898

SEQ ID NO: 53902 - protein, 70 aa, Homo sapiens
MNQKLLKLENLLRFHTIYRQLHSLCQRRALRQWRHGFSSAYPVWTAQLCAWPWPTDVLTGAALSQYRLLV

SEQ ID NO: 53903 - protein, 7 aa, Homo sapiens
MNQKLLK

SEQ ID NO: 53904 - protein, 10 aa, Homo sapiens
MNQKLLKLEN

SEQ ID NO: 53905 - protein, 26 aa, Homo sapiens
MNQKLLKLENLLRFHTIYRQLHSLCQ

SEQ ID NO: 53906 - protein, 71 aa, Homo sapiens
MNQKLLKLENLLRFHTIYRQLHSLCQRRALRQWRHGFSSAYPVWTAQLCAWPWPTDVLTGAALSQYRLLVT

SEQ ID NO: 53907 - protein, 465 aa, Homo sapiens
MNQKLLKLENLLRFHTIYRQLHSLCQRRALRQWRHGFSSAYPVWTAQLCAWPWPTDVLTGAALSQYRLLVTKKEEGPWKSQLSSTKSKKVVEVWIGMTIEELARAMEKNTDYVYEALLNTDIDIDSLEADSHLDEVWIKEVITKAGMKLKWSKLKQDKVRKNKDAVRRPQADPALLTPRSPVVTIMGHVDHGKTTLLDKFRKTQVAAVETGGITQHIGAFLVSLPSGEKITFLDTPGHAAFSAMRARGAQVTDIVVLVVAADDGVMKQTVESIQHAKDAQVPIILAVNKCDKAEADPEKVKKELLAYDVVCEDYGGDVQAVPVSALTGDNLMALAEATVALAEMLELKADPNGPVEGTVIESFTDKGRGLVTTAIIQRGTLRKGSVLVAGKCWAKVRLMFDENGKTIDEAYPSMPVGITGWRDLPSAGEEILEVESEPRAREVVDWRKYEQEQEKGQEDLKKEKN

SEQ ID NO: 53908 - protein, 151 aa, Homo sapiens
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKKTESCSVAQAGMQ

SEQ ID NO: 53909 - protein, 445 aa, Homo sapiens
MNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKEFLCGGKGLDQLIQRLLQSADEEAIAELLDEHLKSAK

SEQ ID NO: 53910 - protein, 445 aa, Homo sapiens; identical to SEQ ID NO: 53909

SEQ ID NO: 53911 - protein, 468 aa, Homo sapiens
MGNGEVVLFSDAEMNRHLCVWLFRHPSLNGYLQCHIQLHSHQFRQIHLDTRLQVFRQNRNCILHLLSKNWSRRYCHQDTKMLWKHKALQKYMENLSKEYQTLEQCLQHIPVNEENRRSLNRRHAELAPLAAIYQEIQETEQAIEELESMCKSLNKQDEKQLQELALEERQTIDQKINMLYNELFQSLVPKEKYDKNDVILEVTAGRTTGGDICQQFTREIFDMYQNYSCYKHWQFELLNYTPADYGGLHHAAARISGDGVYKHLKYEGGIHRVQRIPEVGLSSRMQRIHTGTMSVIVLPQPDEVDVKLDPKDLRIDTFRAKGAGGQHVNKTDSAVRLVHIPTGLVVECQQERSQIKNKEIAFRVLRARLYQQIIEKDKRQQQSARKLQVGTRAQSERIRTYNFTQDRVSDHRIAYEVRDIKAQSHSTGGSRDPAHSTFLSLDSVRSPGILIMTSSVRNFYVVGRAWIS

SEQ ID NO: 53912 - protein, 757 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMKVAFFGRTSNGKSTVINAMLWDKVLPSGIGHTTNCFLRVEGTDGHEAFLLTEGSEEKRSAKTVNQLAHALHQDKQLHAGSLVSVMWPNSKCPLLKDDLVLMDSPGIDVTTELDSWIDKFCLDADVFVLVANSESTLMQTEKHFFHKVSERLSRPNIFILNNRWDASASEPEYMEEVRRQHMERCTSFLVDELGVVDRSQAGDRIFFVSAKEVLNARIQKAQGMPEGGGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDVTRENLEQEIAAMNKKIEVLDSLQSKAKLLRNKAGWLDSELNMFTHQYLQPSR

SEQ ID NO: 53913 - protein, 436 aa, Homo sapiens
MHPHLSTLSLPRRRSMAFLSSWGALAEGFQVRMFEFQNFERRFEECISQSAVKTKFEQHTVRAKQIAEAVRLIMDSLHMAAREQQVYCEEMREERQDRLKFIDKQLELLAQDYKLRIKQITEEVERQVSTAMAEEIRRLSVLVDDYQMDFHPSPVVLKVYKNELHRHIEEGLGRNMSDRCSTAITNSLQTMQQDMIDGLKPLLPVSVRSQIDMLVPRQCFSLNYDLNCDKLCADFQEDIEFHFSLGWTMLVNRFLGPKNSRRALMGYNDQVQRPIPLTPANPSMPPLPQGSLTQEEFMVSMVTGLASLTSRTSMGILVVGGVVWKAVGWRLIALSFGLYGLLYVYERLTWTTKAKERAFKRQFVEHASEKLQLVISYTGSNCSHQVQQELSGTFAHLCQQVDGETLSERSMAKSTLMLLTLLFLCSFAGAQDVLTQ

SEQ ID NO: 53914 - protein, 98 aa, Homo sapiens
MSLLFSRCNSIVTVKKNKRHMAEVNASPLKHFVTAKKKINGIFEQLGAYIQESATFLEDTYRNAELDPVTTEEQVLDVKGYLSKVRGISEVLARRHMK

SEQ ID NO: 53915 - protein, 757 aa, Homo sapiens; identical to SEQ ID NO: 53912

SEQ ID NO: 53916 - protein, 464 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 53917 - protein, 422 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 53918 - protein, 319 aa, Homo sapiens
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 53919 - protein, 277 aa, Homo sapiens
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 53920 - protein, 422 aa, Homo sapiens; identical to SEQ ID NO: 53917

SEQ ID NO: 53921 - protein, 426 aa, Homo sapiens
MSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDIWSVGCIMGEMVRHKILFPGRDYIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 53922 - protein, 426 aa, Homo sapiens; identical to SEQ ID NO: 53921

SEQ ID NO: 53923 - protein, 319 aa, Homo sapiens
MELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDMWSVGCIMGEMIKGAVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSGAAVNSSESLPPSSSVNDISSMSTDQTLASDTDSSLEASAGPLGCCR

SEQ ID NO: 53924 - protein, 33 aa, Homo sapiens
MSKSKVDNQFYSVEVGDSTFTVLKRYQNLKPIG

SEQ ID NO: 53925 - protein, 51 aa, Homo sapiens
MSLHFLYYCSEPTLDVKIAFCQGFDKQVDVSYIAKHYNMSKSKVDNQFYSV

SEQ ID NO: 53926 - protein, 91 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVA

SEQ ID NO: 53927 - protein, 74 aa, Homo sapiens
MSKSKVDNQFYSVEVGDSTFTVLKRYQNLKPIGSGAQGIVCAAYDAVLDRNVAIKKLSRPFQNQTHAKRAYREL

SEQ ID NO: 53928 - protein, 121 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHK

SEQ ID NO: 53929 - protein, 117 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKC

SEQ ID NO: 53930 - protein, 141 aa, Homo sapiens
MSLHFLYYCSEPTLDVKIAFCQGFDKQVDVSYIAKHYNMSKSKVDNQFYSVEVGDSTFTVLKRYQNLKPIGSGAQGIVCAAYDAVLDRNVAIKKLSRPFQNQTHAKRAYRELVLMKCVNHKNIISLLNVFTPQKTLEEFQD

SEQ ID NO: 53931 - protein, 84 aa, Homo sapiens
MSKSKVDNQFYSVEVGDSTFTVLKRYQNLKPIGSGAQGIVCAAYDAVLDRNVAIKKLSRPFQNQTHAKRAYRELVLMKCVNHKN

SEQ ID NO: 53932 - protein, 52 aa, Homo sapiens
MSKSKVDNQFYSVEVGDSTFTVLKRYQNLKPIGSGAQGIVCAAYDAVLDRNV

SEQ ID NO: 53933 - protein, 48 aa, Homo sapiens
MSLHFLYYCSEPTLDVKIAFCQGFDKQVDVSYIAKHYNMSKSKVDNQF

SEQ ID NO: 53934 - protein, 335 aa, Homo sapiens
  MOD_RES (1)..(1): Any amino acid
XNVAIKKLSRPFQNQTHAKRAYRELVLMKCVNHKNIISLLNVFTPQKTLEEFQDVYLVMELMDANLCQVIQMELDHERMSYLLYQMLCGIKHLHSAGIIHRDLKPSNIVVKSDCTLKILDFGLARTAGTSFMMTPYVVTRYYRAPEVILGMGYKENVDMWSVGCIMGEMIKGAVLFPGTDHIDQWNKVIEQLGTPCPEFMKKLQPTVRNYVENRPKYAGLTFPKLFPDSLFPADSEHNKLKASQARDLLSKMLVIDPAKRISVDDALQHPYINVWYDPAEVEAPPPQIYDKQLDEREHTIEEWKELIYKEVMNSEEKTKNGVVKGQPSPSAQVQQ

SEQ ID NO: 53935 - protein, 587 aa, Homo sapiens
MAEKGDCIASVYGYDLGGRFVDFQPLGFGVNGLVLSAVDSRACRKVAVKKIALSDARSMKHALREIKIIRRLDHDNIVKVYEVLGPKGTDLQGELFKFSVAYIVQEYMETDLARLLEQGTLAEEHAKLFMYQLLRGLKYIHSANVLHRDLKPANIFISTEDLVLKIGDFGLARIVDQHYSHKGYLSEGLVTKWYRSPRLLLSPNNYTKAIDMWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRAGSAPLAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRLSASPPGRPAPVDGGASPQFDLDVFISRALKLCTKPEDLPDNKLGDLNGACIPEHPGDLVQTEAFSKERW

SEQ ID NO: 53936 - protein, 376 aa, Homo sapiens
MWAAGCILAEMLTGRMLFAGAHELEQMQLILETIPVIREEDKDELLRVMPSFVSSTWEVKRPLRKLLPEVNSEAIDFLEKILTFNPMDRLTAEMGLQHPYMSPYSCPEDEPTSQHPFRIEDEIDDIVLMAANQSQLSNWDTCSSRYPVSLSSDLEWRPDRCQDASEVQRDPRAGSAPLAEDVQVDPRKDSHSSSERFLEQSHSSMERAFEADYGRSCDYKVGSPSYLDKLLWRDNKPHHYSEPKLILDLSHWKQAAGAPPTATGLADTGAREDEPASLFLEIAQWVKSTQGGPEHASPPADDPERRLSASPPGRPAPVDGGASPQFDLDVFISRALKLCTKPEDLPDNKLGDLNGACIPEHPGDLVQTEAFSKERW

SEQ ID NO: 53937 - protein, 677 aa, Homo sapiens
MESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 53938 - protein, 816 aa, Homo sapiens
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQAIDLWSVGCIFGEMLARRQLFPGKNYVHQLQLIMMVLGTPSPAVIQAVGAERVRAYIQSLPPRQPVPWETVYPGADRQALSLLGRMLRFEPSARISAAAALRHPFLAKYHDPDDEPDCAPPFDFAFDREALTRERIKEAIVAEIEDFHARREGIRQQIRFQPSLQPVASEPGCPDVEMPSPWAPSGDCAMESPPPAPPPCPGPAPDTIDLTLQPPPPVSEPAPPKKDGAISDNTKAALKAALLKSLRSRLRDGPSAPLEAPEPRKPVTAQERQREREEKRRRRQERAKEREKRRQERERKERGAGASGGPSTDPLAGLVLSDNDRSLLERWTRMARPAAPALTSVPAPAPAPTPTPTPVQPTSPPPGPVAQPTGPQPQSAGSTSGPVPQPACPPPGPAPHPTGPPGPIPVPAPPQIATSTSLLAAQSLVPPPGLPGSSTPGVLPYFPPGLPPPDAGGAPQSSMSESPDVNLVTQQLSKSQVEDPLPPVFSGTPKGSGAGYGVGFDLEEFLNQSFDMGVADGPQDGQADSASLSASLLADWLEGHGMNPADIESLQREIQMDSPMLLADLPDLQDP

SEQ ID NO: 53939 - protein, 816 aa, Homo sapiens; identical to SEQ ID NO: 53938

SEQ ID NO: 53940 - protein, 816 aa, Homo sapiens; identical to SEQ ID NO: 53938

SEQ ID NO: 53941 - protein, 241 aa, Homo sapiens
MAEPLKEEDGEDGSAEPPGPVKAEPAHTAASVAAKNLALLKARSFDVTFDVGDEYEIIETIGNGAYGVVSSARRRLTGQQVAIKKIPNAFDVVTNAKRTLRELKILKHFKHDNIIAIKDILRPTVPYGEFKSVYVVLDLMESDLHQIIHSSQPLTLEHVRYFLYQLLRGLKYMHSAQVIHRDLKPSNLLVNENCELKIGDFGMARGLCTSPAEHQYFMTEYVATRWYRAPELMLSLHEYTQ

SEQ ID NO: 53942 - protein, 711 aa, Homo sapiens
MAERESGGLGGGAASPPAASPFLGLHIASPPNFRLTHDISLEEFEDEDLSEITDECGISLQCKDTLSLRPPRAGLLSAGGGGAGSRLQAEMLQMDLIDATGDTPGAEDDEEDDDEERAARRPGAGPPKAESGQEPASRGQGQSQGQSQGPGSGDTYRPKRPTTLNLFPQVPRSQDTLNNNSLGKKHSWQDRVSRSSSPLKTGEQTPPHEHICLSDELPPQSGPAPTTDRGTSTDSPCRRSTATQMAPPGGPPAAPPGGRGHSHRDRIHYQADVRLEATEEIYLTPVQRPPDAAEPTSAFLPPTESRMSVSSDPDPAAYPSTAGRPHPSISEEEEGFDCLSSPERAEPPGGGWRGSLGEPPPPPRASLSSDTSALSYDSVKYTLVVDEHAQLELVSLRPCFGDYSDESDSATVYDNCASVSSPYESAIGEEYEEAPRPQPPACLSEDSTPDEPDVHFSKKFLNVFMSGRSRSSSAESFGLFSCIINGEEQEQTHRAIFRFVPRHEDELELEVDDPLLVELQAEDYWYEAYNMRTGARGVFPAYYAIEVTKEPEHMAALAKNSDWVDQFRVKFLGSVQVPYHKGNDVLCAAMQKIATTRRLTVHFNPPSSCVLEISVRGVKIGVKADDSQEAKGNKCSHFFQLKNISFCGYHPKNNKYFGFITKHPADHRFACHVFVSEDSTKALAESVGRAFQQFYKQFVEYTCPTEDIYLE

SEQ ID NO: 53943 - protein, 598 aa, Homo sapiens
MLPDFPSPSTWAPGLLLPSGPALLSPSVLQDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSQDPEAAAGPGGVELVDMETLNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCEAPQGAAFQWERGVDRKRVLQTRGNVQPHLGAGQGAALNRATEGSSTGSEKGEWTPLVIMELTQSVNSCYFGFITKHPLLSRFACHVFVSQESMRPVAQSVGRAFLEYYQEHLAYACPTEDIYLE

SEQ ID NO: 53944 - protein, 823 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGRLGRMISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 53945 - protein, 444 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 53946 - protein, 558 aa, Homo sapiens
MISSISETELELSSDGGSSSSGRSSHLTNSIEEASSPASEPEPPREPPRRPAFLPVGPDDTNSEYESGSESEPDLSEDADSPWLLSNLVSRMISEGSSPIRCPGQCLSPAPRPPGEPVSPAGGAAQDSQDPEAAAGPGGVELVDMETLCAPPPPAPAAPRPGPAQPGPCLFLSNPTRDTITPLWAAPGRAARPGRACSAACSEEEDEEDDEEEEDAEDSAGSPGGRGTGPSAPRDASLVYDAVKYTLVVDEHTQLELVSLRRCAGLGHDSEEDSGGEASEEEAGAALLGGGQVSGDTSPDSPDLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 53947 - protein, 558 aa, Homo sapiens; identical to SEQ ID NO: 53946

SEQ ID NO: 53948 - protein, 546 aa, Homo sapiens
MADRAEMFSLSTFHSLSPPGCRPPQDISLEEFDDEDLSEITDDCGLGLSYDSDHCEKDSLSLGRSEQPHPICSFQDDFQEFEMIDDNEEEDDEDEEEEEEEEEGDGEGQEGGDPGSEAPAPGPLIPSPSVEEPHKHRPTTLRLTTLGAQDSLNNNGGFDLVRPASWQETALCSPAPEALRELPGPLPATDTGPGGAQSPVRPGCDCEGNRPAEPPAPGGTSPSSDPGIEADLRSRSSGGRGGRRSSQELSSPGSDSEDAGGRLGRMISSISETELELSSDGGSSSSGRSSHLTFSKKFLNVFVNSTSRSSSTESFGLFSCLVNGEEREQTHRAVFRFIPRHPDELELDVDDPVLVEAEEDDFWFRGFNMRTGERGVFPAFYAHAVPGPAKDLLGSKRSPCWVERFDVQFLGSVEVPCHQGNGILCAAMQKIATARKLTVHLRPPASCDLEISLRGVKLSLSGGGPEFQRCSHFFQMKNISFCGCHPRNSCYFGFITKHPLLSRFACHVFVSQESMRPVAQSVGRAFLEYYQEHLAYACPTEDIYLE

SEQ ID NO: 53949 - protein, 382 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 53950 - protein, 382 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSAQMQQ

SEQ ID NO: 53951 - protein, 124 aa, Homo sapiens
MSDSKCDSQFYSVQVADSTFTVLKRYQQLKPIGSGAQGIVWRHHCSALPFIGRMRPVSVIVTPWINQEGMLCEGLGWPSLPWCLTSTVCPAQNVRIVSLTLNVSLLHGKTVSRRSITGQLKCCI

SEQ ID NO: 53952 - protein, 242 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDRILPRDLGPAMLS

SEQ ID NO: 53953 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMGELVKGCVIFQGTDHIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 53954 - protein, 424 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENVDIWSVGCIMAEMVLHKVLFPGRDYIDQWNKVIEQLGTPSAEFMKKLQPTVRNYVENRPKYPGIKFEELFPDWIFPSESERDKIKTSQARDLLSKMLVIDPDKRISVDEALRHPYITVWYDPAEAEAPPPQIYDAQLEEREHAIEEWKELIYKEVMDWEERSKNGVVKDQPSDAAVSSNATPSQSSSINDISSMSTEQTLASDTDSSLDASTGPLEGCR

SEQ ID NO: 53955 - protein, 104 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDV

SEQ ID NO: 53956 - protein, 214 aa, Homo sapiens
MSDSKCDSQFYSVQVADSTFTVLKRYQQLKPIGSGAQGIVCAAFDTVLGINVAVKKLSRPFQNQTHAKRAYRELVLLKCVNHKNIISLLNVFTPQKTLEEFQDVYLVMELMDANLCQVIHMELDHERMSYLLYQMLCGIKHLHSAGIIHRDLKPSNIVVKSDCTLKILDFGLARTACTNFMMTPYVVTRYYRAPEVILGMGYKENAIKYWTLWH

SEQ ID NO: 53957 - protein, 448 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 53958 - protein, 438 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 53959 - protein, 444 aa, Homo sapiens
MLWLALGPFPAMENQVLVIRIKIPNSGAVDWTVHSGPQLLFRDVLDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMEIQKNQGSLMPLQLLQCIVDEDSPVLPVGEFSEPFVHFITQCMRKQPKERPAPEELMGHPFIVQFNDGNAAVVSMWVCRALEERRSPASLPSPSSSI

SEQ ID NO: 53960 - protein, 412 aa, Homo sapiens
MMEGHFPQSDVIGQVLPEATTTAFEYEDEDGDRITVRSDEEMKAMLSYYYSTVMEQQVNGQLIEPLQIFPRACKPPGERNIHGLKVNTRAGPSQHSSPAVSDSLPSNSLKKSSAELKKILANGQMNEQDIRYRDTLGHGNGGTVYKAYHVPSGKILAVKVILLDITLELQKQIMSELEILYKCDSSYIIGFYGAFFVENRISICTEFMDGGSLDVYRKMPEHVLGRIAVAVVKGLTYLWSLKILHRDVKPSNMLVNTRGQVKLCDFGVSTQLVNSIAKTYVGTNAYMAPERISGEQYGIHSDVWSLGISFMELALGRFPYPQIQKNQGSLMPLQLLQCIVDEDSPVLPVGEFSEPFVHFITQCMRKQPKERPAPEELMGHPFIVQFNDGNAAVVSMWVCRALEERRSQQGPP

SEQ ID NO: 53961 - protein, 334 aa, Homo sapiens
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRFPYDSWGTPFQQLKQVVEEPSPQLPADKFSAEFVDFTSQCLKKNSKERPTYPELMQHPFFTLHESKGTDVASFVKLILGD

SEQ ID NO: 53962 - protein, 334 aa, Homo sapiens; identical to SEQ ID NO: 53961

SEQ ID NO: 53963 - protein, 954 aa, Homo sapiens
MEEEEGAVAKEWGTTPAGPVWTAVFDYEAAGDEELTLRRGDRVQVLSQDCAVSGDEGWWTGQLPSGRVGVFPSNYVAPGAPAAPAGLQLPQEIPFHELQLEEIIGVGGFGKVYRALWRGEEVAVKAARLDPEKDPAVTAEQVCQEARLFGALQHPNIIALRGACLNPPHLCLVMEYARGGALSRVLAGRRVPPHVLVNWAVQVARGMNYLHNDAPVPIIHRDLKSINILILEAIENHNLADTVLKITDFGLAREWHKTTKMSAAGTYAWMAPEVIRLSLFSKSSDVWSFGVLLWELLTGEVPYREIDALAVAYGVAMNKLTLPIPSTCPEPFARLLEECWDPDPHGRPDFGSILKRLEVIEQSALFQMPLESFHSLQEDWKLEIQHMFDDLRTKEKELRSREEELLRAAQEQRFQEEQLRRREQELAEREMDIVERELHLLMCQLSQEKPRVRKRKGNFKRSRLLKLREGGSHISLPSGFEHKITVQASPTLDKRKGSDGASPPASPSIIPRLRAIRLTPVDCGGSSSGSSSGGSGTWSRGGPPKKEELVGGKKKGRTWGPSSTLQKERVGGEERLKGLGEGSKQWSSSAPNLGKSPKHTPIAPGFASLNEMEEFAEAEDGGSSVPPSPYSTPSYLSVPLPAEPSPGARAPWEPTPSAPPARWGHGARRRCDLALLGCATLLGAVGLGADVAEARAADGEEQRRWLDGLFFPRAGRFPRGLSPPARPHGRREDVGPGLGLAPSATLVSLSSVSDCNSTRSLLRSDSDEAAPAAPSPPPSPPAPTPTPSPSTNPLVDLELESFKKDPRQSLTPTHVTAACAVSRGHRRTPSDGALGQRGPPEPAGHGPGPRDLLDFPRLPDPQALFPARRRPPEFPGRPTTLTFAPRPRPAASRPRLDPWKLVSFGRTLTISPPSRPDTPESPGPPSVQPTLLDMDMEGQNQDSTVPLCGAHGSH

SEQ ID NO: 53964 - protein, 847 aa, Homo sapiens
MEPLKSLFLKSPLGSWNGSGSGGGGGGGGGRPEGSPKAAGYANPVWTALFDYEPSGQDELALRKGDRVEVLSRDAAISGDEGWWAGQVGGQVGIFPSNYVSRGGGPPPCEVASFQELRLEEVIGIGGFGKVYRGSWRGELVAVKAARQDPDEDISVTAESVRQEARLFAMLAHPNIIALKAVCLEEPNLCLVMEYAAGGPLSRALAGRRVPPHVLVNWAVQIARGMHYLHCEALVPVIHRDLKSNNILLLQPIESDDMEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQDPHRRPDFASILQQLEALEAQVLREMPRDSFHSMQEGWKREIQGLFDELRAKEKELLSREEELTRAAREQRSQAEQLRRREHLLAQWELEVFERELTLLLQQVDRERPHVRRRRGTFKRSKLRARDGGERISMPLDFKHRITVQASPGLDRRRNVFEVGPGDSPTFPRFRAIQLEPAEPGQAWGRQSPRRLEDSSNGERRACWAWGPSSPKPGEAQNGRRRSRMDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 53965 - protein, 590 aa, Homo sapiens
MEHKTLKITDFGLAREWHKTTQMSAAGTYAWMAPEVIKASTFSKGSDVWSFGVLLWELLTGEVPYRGIDCLAVAYGVAVNKLTLPIPSTCPEPFAQLMADCWAQDPHRRPDFASILQQLEALEAQVLREMPRDSFHSMQEGWKREIQGLFDELRAKEKELLSREEELTRAAREQRSQAEQLRRREHLLAQWELEVFERELTLLLQQVDRERPHVRRRRGTFKRSKLRARDGGERISMPLDFKHRITVQASPGLDRRRNVFEVGPGDSPTFPRFRAIQLEPAEPGQAWGRQSPRRLEDSSNGERRACWAWGPSSPKPGEAQNGRRRSRMDEATWYLDSDDSSPLGSPSTPPALNGNPPRPSLEPEEPKRPVPAERGSSSGTPKLIQRALLRGTALLASLGLGRDLQPPGGPGRERGESPTTPPTPTPAPCPTEPPPSPLICFSLKTPDSPPTPAPLLLDLGIPVGQRSAKSPRREEEPRGGTVSPPPGTSRSAPGTPGTPRSPPLGLISRPRPSPLRSRIDPWSFVSAGPRPSPLPSPQPAPRRAPWTLFPDSDPFWDSPPANPFQGGPQDCRAQTKDMGAQAPWVPEAGP

SEQ ID NO: 53966 - protein, 859 aa, Homo sapiens
MACLHETRTPSPSFGGFVSTLSEASMRKLDPDTSDCTPEKDLTPTHVLQLHEQDAGGPGGAAGSPESRASRVRADEVRLQCQSGSGFLEGLFGCLRPVWTMIGKAYSTEHKQQQEDLWEVPFEEILDLQWVGSGAQGAVFLGRFHGEEVAVKKVRDLKETDIKHLRKLKHPNIITFKGVCTQAPCYCILMEFCAQGQLYEVLRAGRPVTPSLLVDWSMGIAGGMNYLHLHKIIHRDLKSPNMLITYDDVVKISDFGTSKELSDKSTKMSFAGTVAWMAPEVIRNEPVSEKVDIWSFGVVLWELLTGEIPYKDVDSSAIIWGVGSNSLHLPVPSSCPDGFKILLRQCWNSKPRNRPSFRQILLHLDIASADVLSTPQETYFKSQAEWREEVKLHFEKIKSEGTCLHRLEEELVMRRREELRHALDIREHYERKLERANNLYMELNALMLQLELKERELLRREQALERRCPGLLKPHPSRGLLHGNTMEKLIKKRNVPQKLSPHSKRPDILKTESLLPKLDAALSGVGLPGCPKGPPSPGRSRRGKTRHRKASAKGSCGDLPGLRTAVPPHEPGGPGSPGGLGGGPSAWEACPPALRGLHHDLLLRKMSSSSPDLLSAALGSRGRGATGGAGDPGSPPPARGDTPPSEGSAPGSTSPDSPGGAKGEPPPPVGPGEGVGLLGTGREGTSGRGGSRAGSQHLTPAALLYRAAVTRSQKRGISSEEEEGEVDSEVELTSSQRWPQSLNMRQSLSTFSSENPSDGEEGTASEPSPSGTPEVGSTNTDERPDERSDDMCSQGSEIPLDPPPSEVIPGPEPSSLPIPHQELLRERGPPNSEDSDCDSTELDNSNSVDALRPPASLPP

SEQ ID NO: 53967 - protein, 966 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGCLRPVWNIIGKAYSTDYKLQQQDTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 53968 - protein, 966 aa, Homo sapiens; identical to SEQ ID NO: 53967

SEQ ID NO: 53969 - protein, 137 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGTEDIKIQFSRSGSGSGGFLEGLFGC

SEQ ID NO: 53970 - protein, 113 aa, Homo sapiens
MANFQEHLSCSSSPHLPFSESKTFNGLQDELTAMGNHPSPKLLEDQQEKGMVRTELIESVHSPVTTTVLTSVSEDSRDQFENSVLQLREHDESETAVSQGNSNTVDGESTSGT

SEQ ID NO: 53971 - protein, 822 aa, Homo sapiens
MSYVECKCLQLENKNTWEVPFEEISELQWLGSGAQGAVFLGKFRAEEVAIKKVREQNETDIKHLRKLKHPNIIAFKGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 53972 - protein, 759 aa, Homo sapiens
MYCGIQILALWERGVCTQAPCYCIIMEYCAHGQLYEVLRAGRKITPRLLVDWSTGIASGMNYLHLHKIIHRDLKSPNVLVTHTDAVKISDFGTSKELSDKSTKMSFAGTVAWMAPEVIRNEPVSEKVDIWSFGVVLWELLTGEIPYKDVDSSAIIWGVGSNSLHLPVPSTCPDGFKILMKQTWQSKPRNRPSFRQTLMHLDIASADVLATPQETYFKSQAEWREEVKKHFEKIKSEGTCIHRLDEELIRRRREELRHALDIREHYERKLERANNLYMELSAIMLQLEMREKELIKREQAVEKKYPGTYKRHPVRPIIHPNAMEKLMKRKGVPHKSGMQTKRPDLLRSEGIPTTEVAPTASPLSGSPKMSTSSSKSRYRSKPRHRRGNSRGSHSDFAAILKNQPAQENSPHPTYLHQAQSQYPSLHHHNSLQQQYQQPPPAMSQSHHPRLNMHGQDIATCANNLRYFGPAAALRSPLSNHAQRQLPGSSPDLISTAMAADCWRSSEPDKGQAGPWGCCQADAYDPCLQCRPEQYGSLDIPSAEPVGRSPDLSKSPAHNPLLENAQSSEKTEENEFSGCRSESSLGTSHLGTPPALPRKTRPLQKSGDDSSEEEEGEVDSEVEFPRRQRPHRCISSCQSYSTFSSENFSVSDGEEGNTSDHSNSPDELADKLEDRLAEKLDDLLSQTPEIPIDISSHSDGLSDKECAVRRVKTQMSLGKLCVEERGYENPMQFEESDCDSSDGECSDATVRTNKHYSSATW

SEQ ID NO: 53973 - protein, 946 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRALPRSELHKLISPLQCLNHVWKLHHPQDGGPLPLPTHPFPYSRLPHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKIASEPPPVREIPPSCAPLTAQAIQEGLRKEPIHRVSAAELGGKVNRALQQVGGLKSPWRGEYKEPRHPPPNQANYHQTLHAQPRELSPRAPGPRPAEETTGRAPKLQPPLPPEPPEPNKSPPLTLSKEESGMWEPLPLSSLEPAPARNPSSPERKATVPEQELQQLEIELFLNSLSQPFSLEEQEQILSCLSIDSLSLSDDSEKNPSKASQSSRDTLSSGVHSWSSQAEARSSSWNMVLARGRPTDTPSYFNGVKVQIQSLNGEHLHIREFHRVKVGDIATGISSQIPAAAFSLVTKDGQPVRYDMEVPDSGIDLQCTLAPDGSFAWSWRVKHGQLENRP

SEQ ID NO: 53974 - protein, 433 aa, Homo sapiens
CFKQLGEGLRALPRSELHKLISPLQCLNHVWKLHHPQDGGPLPLPTHHPFPFHPLQPWKPHPLESFLGKLACVDSQKPLPDPHLSKLACVDSPKPLPGPHLEPSCLSRGAHEKFSVEEYLVHALQGSVSSGQAHSLTSLAKTWAARGSRSREPSPKTEDNEGVLLTEKLKPVDYEYREEVHWATHQLRLGRGSFGEVHRMEDKQTGFQCAVKKVRLEVFRAEELMACAGLTSPRIVPLYGAVREGPWVNIFMELLEGGSLGQLVKEQGCLPEDRALYYLGQALEGLEYLHSRRILHGDVKADNVLLSSDGSHAALCDFGHAVCLQPDGLGKSLLTGDYIPGTETHMAPEVVLGRSCDAKVDVWSSCCMMLHMLNGCHPWTQFFRGPLCLKVGDGTQHGQQGELQGPGAQAAGWRGCSAVADGARGGLVIHVGS

SEQ ID NO: 53975 - protein, 1313 aa, Homo sapiens
MESGGGNAPAGALGAASESPQCPPPPGVEGAAGPAEPDGAAEGAAGGSGEGESGGGPRRALRAVYVRSESSQGGAAGGPEAGARQCLLRACEAEGAHLTSVPFGELDFGETAVLDAFYDADVAVVDMSDVSRQPSLFYHLGVRESFDMANNVILYHDTDADTALSLKDMVTQKNTASSGNYYFIPYIVTPCADYFCCESDAQRRASEYMQPNWDNILGPLCMPLVDRFISLLKDIHVTSCVYYKETLLNDIRKAREKYQGEELAKELARIKLRMDNTEVLTSDIIINLLLSYRDIQDYDAMVKLVETLEMLPTCDLADQHNIKFHYAFALNRRNSTGDREKALQIMLQVLQSCDHPGPDMFCLCGRIYKDIFLDSDCKDDTSRDSAIEWYRKGFELQSSLYSGINLAVLLIVAGQQFETSLELRKIGVRLNSLLGRKGSLEKMNNYWDVGQFFSVSMLAHDVGKAVQAAERLFKLKPPVWYLRSLVQNLLLIRRFKKTIIEHSPRQERLNFWLDIIFEATNEVTNGLRFPVLVIEPTKVYQPSYVSINNEAEERTVSLWHVSPTEMKQMHEWNFTASSIKGISLSKFDERCCFLYVHDNSDDFQIYFSTEEQCSRFFSLVKEMITNTAGSTVELEGETDGDTLEYEYDHDANGERVVLGKGTYGIVYAGRDLSNQVRIAIKEIPERDSRYSQPLHEEIALHKYLKHRNIVQYLGSVSENGYIKIFMEQVPGGSLSALLRSKWGPMKEPTIKFYTKQILEGLKYLHENQIVHRDIKGDNVLVNTYSGVVKISDFGTSKRLAGVNPCTETFTGTLQYMAPEIIDQGPRGYGAPADIWSLGCTIIEMATSKPPFHELGEPQAAMFKVGMFKIHPEIPEALSAEARAFILSCFEPDPHKRATTAELLREGFLRQVNKGKKNRIAFKPSEGPRGVVLALPTQGEPMATSSSEHGSVSPDSDAQPDALFERTRAPRHHLGHLLSVPDESSALEDRGLASSPEDRDQGLFLLRKDSERRAILYKILWEEQNQVASNLQECVAQSSEELHLSVGHIKQIIGILRDFIRSPEHRVMATTISKLKVDLDFDSSSISQIHLVLFGFQDAVNKILRNHLIRPHWMFAMDNIIRRAVQAAVTILIPELRAHFEPTCETEGVDKDMDEAEEGYPPATGPGQEAQPHQQHLSLQLGELRQETNRLLEHLVEKEREYQNLLRQTLEQKTQELYHLQLKLKSNCITENPAGPYGQRTDKELIDWLRLQGADAKTIEKIVEEGYTLSDILNEITKEDLRYLRLRGGLLCRLWSAVSQYRRAQEASETKDKA

SEQ ID NO: 53976 - protein, 1558 aa, Homo sapiens
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 53977 - protein, 1608 aa, Homo sapiens
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFSTRSMPSDARSHGSPAAAAAAAAAAVAASRPSPSGGDSVLPKSISSAHDTRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKRPWHEYEHNFQIMYKVGMGHKPPIPERLSPEGKDFLSHCLESDPKMRWTASQLLDHSFVKVCTDEE

SEQ ID NO: 53978 - protein, 1498 aa, Homo sapiens
MREAAAALVPPPAFAVTPAAAMEEPPPPPPPPPPPPEPETESEPECCLAARQEGTLGDSACKSPESDLEDFSDETNTENLYGTSPPSTPRQMKRMSTKHQRNNVGRPASRSNLKEKMNAPNQPPHKDTGKTVENVEEYSYKQEKKIRAALRTTERDRKKNVQCSFMLDSVGGSLPKKSIPDVDLNKPYLSLGCSNAKLPVSVPMPIARPARQTSRTDCPADRLKFFETLRLLLKLTSVSKKKDREQRGQENTSGFWLNRSNELIWLELQAWHAGRTINDQDFFLYTARQAIPDIINEILTFKVDYGSFAFVRDRAGFNGTSVEGQCKATPGTKIVGYSTHHEHLQRQRVSFEQVKRIMELLEYIEALYPSLQALQKDYEKYAAKDFQDRVQALCLWLNITKDLNQKLRIMGTVLGIKNLSDIGWPVFEIPSPRPSKGNEPEYEGDDTEGELKELESSTDESEEEQISDPRVPEIRQPIDNSFDIQSRDCISKKLERLESEDDSLGWGAPDWSTEAGFSRHCLTSIYRPFVDKALKQMGLRKLILRLHKLMDGSLQRARIALVKNDRPVEFSEFPDPMWGSDYVQLSRTPPSSEEKCSAVSWEELKAMDLPSFEPAFLVLCRVLLNVIHECLKLRLEQRPAGEPSLLSIKQLVRECKEVLKGGLLMKQYYQFMLQEVLEDLEKPDCNIDAFEEDLHKMLMVYFDYMRSWIQMLQQLPQASHSLKNLLEEEWNFTKEITHYIRGGEAQAGKLFCDIAGMLLKSTGSFLEFGLQESCAEFWTSADDSSASDEIRRSVIEISRALKELFHEARERASKALGFAKMLRKDLEIAAEFRLSAPVRDLLDVLKSKQYVKVQIPGLENLQMFVPDTLAEEKSIILQLLNAAAGKDCSKDSDDVLIDAYLLLTKHGDRARDSEDSWGTWEAQPVKVVPQVETVDTLRSMQVDNLLLVVMQSAHLTIQRKAFQQSIEGLMTLCQEQTSSQPVIAKALQQLKNDALELCNRISNAIDRVDHMFTSEFDAEVDESESVTLQQYYREAMIQGYNFGFEYHKEVVRLMSGEFRQKIGDKYISFARKWMNYVLTKCESGRGTRPRWATQGFDFLQAIEPAFISALPEDDFLSLQALMNECIGHVIGKPHSPVTGLYLAIHRNSPRPMKVPRCHSDPPNPHLIIPTPEGFRGSSVPENDRLASIAAELQFRSLSRHSSPTEERDEPAYPRGDSSGSTRRSWELRTLISQSKDTASKLGPIEAIQKSVRLFEEKRYREMRRKNIIGQVCDTPKSYDNVMHVGLRKVTFKWQRGNKIGEGQYGKVYTCISVDTGELMAMKEIRFQPNDHKTIKETADELKIFEGIKHPNLVRYFGVELHREEMYIFMEYCDEGTLEEVSRLGLQEHVIRLYSKQITIAINVLHEHGIVHRDIKGANIFLTSSGLIKLGDFGCSVKLKNNAQTMPGEVNSTLGTAAYMAPEVITRAKGEGHGRAADIWSLGCVVIEMVTGKICKDTE

SEQ ID NO: 53979 - protein, 107 aa, Homo sapiens
MEEPPPPPPPPPPPPEPETESEPECCLAARQEGTLGDSACKSPESDLEDFSDETNTENLYGTSPPSTPRQMKRMSTKHQRNNVGRPASRSNLKGVRQISHAVSSSLN

SEQ ID NO: 53980 - protein, 621 aa, Homo sapiens
MEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 53981 - protein, 1374 aa, Homo sapiens
MSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSALSAGSNEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPELRPHFSLASESDTADQEDLDVEDDHEEQPSNQTVRRPQAVIEDAVATSGVSTLSSTVSHDSQSAHRSLNVQLGRMKIETNRLLEELVRKEKELQALLHRAIEEKDQEIKHLKLKSQPIEIPELPVFHLNSSGTNTEDSELTDWLRVNGADEDTISRFLAEDYTLLDVLYYVTRDDLKCLRLRGGMLCTLWKAIIDFRNKQT

SEQ ID NO: 53982 - protein, 1256 aa, Homo sapiens
TLQRASGAATEAPRRSEPPPGSGVPSGERAPERRRRRGGEGAARDGSCLARRARSSPELWLARRCGWAGDAAAVAARPGEMSTEADEGITFSVPPFAPSGFCTIPEGGICRRGGAAAVGEGEEHQLPPPPPGSFWNVESAAAPGIGCPAATSSSSATRGRGSSVGGGSRRTTVAYVINEASQGQLVVAESEALQSLREACETVGATLETLHFGKLDFGETTVLDRFYNADIAVVEMSDAFRQPSLFYHLGVRESFSMANNIILYCDTNSDSLQSLKEIICQKNTMCTGNYTFVPYMITPHNKVYCCDSSFMKGLTELMQPNFELLLGPICLPLVDRFIQLLKVAQASSSQYFRESILNDIRKARNLYTGKELAAELARIRQRVDNIEVLTADIVINLLLSYRDIQDYDSIVKLVETLEKLPTFDLASHHHVKFHYAFALNRRNLPGDRAKALDIMIPMVQSEGQVASDMYCLVGRIYKDMFLDSNFTDTESRDHGASWFKKAFESEPTLQSGINYAVLLLAAGHQFESSFELRKVGVKLSSLLGKKGNLEKLQSYWEVGFFLGASVLANDHMRVIQASEKLFKLKTPAWYLKSIVETILIYKHFVKLTTEQPVAKQELVDFWMDFLVEATKTDVTVVRFPVLILEPTKIYQPSYLSINNEVEEKTISIWHVLPDDKKGIHEWNFSASSVRGVSISKFEERCCFLYVLHNSDDFQIYFCTELHCKKFFEMVNTITEEKGRSTEEGDCESDLLEYDYEYDENGDRVVLGKGTYGIVYAGRDLSNQVRIAIKEIPERDSRYSQPLHEEIALHKHLKHKNIVQYLGSFSENGFIKIFMEQVPGGSLSALLRSKWGPLKDNEQTIGFYTKQILEGLKYLHDNQIVHRDIKGDNVLINTYSGVLKISDFGTSKRLAGINPCTETFTGTLQYMAPEIIDKGPRGYGKAADIWSLGCTIIEMATGKPPFYELGEPQAAMFKVGMFKVHPEIPESMSAEAKAFILKCFEPDPDKRACANDLLVDEFLKVSSKKKKTQPKLSDLSIAQAEYLRSISLPVPVLVEDTSSSSEYGSVSPDTELKVDPFSFKTRAKSCGERDVKGIRTLFLGIPDENFEDHSAPPSPEEKDSGFFMLRKDSERRATLHRILTEDQDKIVRNLMESLAQGAEEPKLKWEHITTLIASLREFVRSTDRKIIATTLSKLKLELDFDSHGISQVQVVLFGFQDAVNKVLRNHNIKPHWMFALDSIIRKAVQTAITILVPGIKP

SEQ ID NO: 53983 - protein, 1288 aa, Homo sapiens
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALREDVFQKNSDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 53984 - protein, 104 aa, Homo sapiens
MVQLSLLRAETDRLREILAGKEREYQALVQRALQRLNEEARTYVLAPEPPTALSTDQGLVQWLQELNVDSGTIQMGRDGMPHLEGHLGTASRIHTSHLWTLRAE

SEQ ID NO: 53985 - protein, 1280 aa, Homo sapiens
MAGPCPRSGAERAGSCWQDPLAVALSRGRQLAAPPGRGCARSRPLSVVYVLTREPQPGLEPREGTEAEPLPLRCLREACAQVPRPRPPPQLRSLPFGTLELGDTAALDAFYNADVVVLEVSSSLVQPSLFYHLGVRESFSMTNNVLLCSQADLPDLQALRDCVGSYTLIPYVVTATGRVLCGDAGLLRGLADGLVQAGVGTEALLTPLVGRLARLLEATPTDSCGYFRETIRRDIRQARERFSGPQLRQELARLQRRLDSVELLSPDIIMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGRLRAQGLGPALLHRPLFAFPDAVKQILRKRQIRPHWMFVLDSLLSRAVRAALGVLGPEVEKEAVSPRSEELSNEGDSQQSPGQQSPLPVEPEQGPAPLMVQLSLLRAETDRLREILAGKEREYQALVQRALQRLNEEARTYVLAPEPPTALSTDQGLVQWLQELNVDSGTIQMLLNHSFTLHTLLTYATRDDLIYTRIRGGMVCRIWRAILAQRAGSTPVTSGP

SEQ ID NO: 53986 - protein, 798 aa, Homo sapiens
  MOD_RES (1)..(1): Any amino acid
XMNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGWMNGEDKGSF

SEQ ID NO: 53987 - protein, 82 aa, Homo sapiens
  MOD_RES (1)..(1): Any amino acid
XEYQALVQRALQRLNEEARTYVLAPEPPTALSTDQGLVQWLQELNVDSGTIQMGRDGMPHLEGHLGTASRIHTSHLWTLRAE

SEQ ID NO: 53988 - protein, 1288 aa, Homo sapiens; identical to SEQ ID NO: 53983

SEQ ID NO: 53989 - protein, 797 aa, Homo sapiens
MNLLLSYRDVQDYSAIIELVETLQALPTCDVAEQHNVCFHYTFALNRRNRPGDRAKALSVLLPLVQLEGSVAPDLYCMCGRIYKDMFFSSGFQDAGHREQAYHWYRKAFDVEPSLHSGINAAVLLIAAGQHFEDSKELRLIGMKLGCLLARKGCVEKMQYYWDVGFYLGAQILANDPTQVVLAAEQLYKLNAPIWYLVSVMETFLLYQHFRPTPEPPGGPPRRAHFWLHFLLQSCQPFKTACAQGDQCLVLVLEMNKVLLPAKLEVRGTDPVSTVTLSLLEPETQDIPSSWTFPVASICGVSASKRDERCCFLYALPPAQDVQLCFPSVGHCQWFCGLIQAWVTNPDSTAPAEEAEGAGEMLEFDYEYTETGERLVLGKGTYGVVYAGRDRHTRVRIAIKEIPERDSRFSQPLHEEIALHRRLRHKNIVRYLGSASQGGYLKIFMEEVPGGSLSSLLRSVWGPLKDNESTISFYTRQILQGLGYLHDNHIVHRDIKGDNVLINTFSGLLKISDFGTSKRLAGITPCTETFTGTLQYMAPEIIDQGPRGYGKAADIWSLGCTVIEMATGRPPFHELGSPQAAMFQVGMYKVHPPMPSSLSAEAQAFLLRTFEPDPRLRASAQTLLGDPFLQPGKRSRSPSSPRHAPRPSDAPSASPTPSANSTTQSQTFPCPQAPSQHPPSPPKRCLSYGGTSQLRVPEEPAAEEPASPEESSGLSLLHQESKRRAMLAAVLEQELPALAENLHQEQKQEQGARLGRNHVEELLRCLGAHIHTPNRRQLAQELRALQGWMNGEDKGSF

SEQ ID NO: 53990 - protein, 260 aa, Homo sapiens
MDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 53991 - protein, 518 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQARTSCRTGPG

SEQ ID NO: 53992 - protein, 491 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQARTSCRTGPG

SEQ ID NO: 53993 - protein, 606 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTAYSKPKRGHRKTASFGNILDVPEIVISGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 53994 - protein, 579 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNIVKLYGACLNPVCLVMEYAEGGSLYNVLHGAEPLPYYTAAHAMSWCLQCSQGVAYLHSMQPKALIHRDLKPPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQPLAPCPNSKESMAVFEQHCKMAQEYMKVQTEIALLLQRKQELVAELDQDEKDQQNTSRLVQEHKKLLDENKSLSTYYQQCKKQLEVIRSQQQKRQGTS

SEQ ID NO: 53995 - protein, 418 aa, Homo sapiens
MSTASAASSSSSSSAGEMIEAPSQVLNFEEIDYKEIEVEEVVGRGAFGVVCKAKWRAKDVAIKQIESESERKAFIVELRQLSRVNHPNLLLVAGGTVLKICDFGTACDIQTHMTNNKGSAAWMAPEVFEGSNYSEKCDVFSWGIILWEVITRRKPFDEIGGPAFRIMWAVHNGTRPPLIKNLPKPIESLMTRCWSKDPSQRPSMEEIVKIMTHLMRYFPGADEPLQYPCQYSDEGQSNSATSTGSFMDIASTNTSNKSDTNMEQVPATNDTIKRLESKLLKNQAKQQSESGRLSLGASRGSSVESLPPTSEGKRMSADMSEIEARIAATTGNGQPRRRSIQDLTVTGTEPGQVSSRSSSPSVRMITTSGPTSEKPTRSHPWTPDDSTDTNGSDNSIPMAYLTLDHQLQARTSCRTGPG

SEQ ID NO: 53996 - protein, 467 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKPSNIVFMSTKAVLVDFGLSVQMTEDVYFPKDLRGTEIYMSPEVILCRGHSTKADIYSLGATLIHMQTGTPPWVKRYPRSAYPSYLYIIHKQAPPLEDIADDCSPGMRELIEASLERNPNHRPRAADLLKHEALNPPREDQPRCQSLDSALLERKRLLSRKELELPENIADSSCTGSTEESEMLKRQRSLYIDLGALAGYFNLVRGPPTLEYG

SEQ ID NO: 53997 - protein, 467 aa, Homo sapiens; identical to SEQ ID NO: 53996

SEQ ID NO: 53998 - protein, 132 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVRFFPISWVLCAQLSYCSFI

SEQ ID NO: 53999 - protein, 467 aa, Homo sapiens; identical to SEQ ID NO: 53996

SEQ ID NO: 54000 - protein, 223 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCG

SEQ ID NO: 54001 - protein, 255 aa, Homo sapiens
MEYMSTGSDNKEEIDLLIKHLNVSDVIDIMENLYASEEPAVYEPSLMTMCQDSNQNDERSKSLLLSGQEVPWLSSVRYGTVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIK

SEQ ID NO: 54002 - protein, 190 aa, Homo sapiens
  MOD_RES (1)..(1): Any amino acid
XVEDLLAFANHISNTAKHFYGQRPQESGILLNMVITPQNGRYQIDSDVLLIPWKLTYRNIGSDFIPRGAFGKVYLAQDIKTKKRMACKLIPVDQFKPSDVEIQACFRHENIAELYGAVLWGETVHLFMEAGEGGSVLEKLESCGPMREFEIIWVTKHVLKGLDFLHSKKVIHHDIKRKYLWTYTFLAQRD

SEQ ID NO: 54003 - protein, 467 aa, Homo sapiens; identical to SEQ ID NO: 53996

SEQ ID NO: 54004 - protein, 1118 aa, Homo sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMALLAASWVVPIDIEEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 54005 - protein, 820 aa, Homo sapiens
LVLILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGLKSLVDGYKQWSSSAPNLVKGPRSSPALPGFTSLMEMACFSSTLVIFTEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 54006 - protein, 1104 aa, Homo sapiens
MEPSRALLGCLASAAAAAPPGEDGAGAGAEEEEEEEEEAAAAVGPGELGCDAPLPYWTAVFEYEAAGEDELTLRLGDVVEVLSKDSQVSGDEGWWTGQLNQRVGIFPSNYVTPRSAFSSRCQPGGEDPSCYPPIQLLEIDFAELTLEEIIGIGGFGKVYRAFWIGDEVAVKAARHDPDEDISQTIENVRQEAKLFAMLKHPNIIALRGVCLKEPNLCLVMEFARGGPLNRVLSGKRIPPDILVNWAVQIARGMNYLHDEAIVPIIHRDLKSSNILILQKVENGDLSNKILKITDFGLAREWHRTTKMSAAGTYAWMAPEVIRASMFSKGSDVWSYGVLLWELLTGEVPFRGIDGLAVAYGVAMNKLALPIPSTCPEPFAKLMEDCWNPDPHSRPSFTNILDQLTTIEESGFFEMPKDSFHCLQDNWKHEIQEMFDQLRAKEKELRTWEEELTRAALQQKNQEELLRRREQELAEREIDILERELNIIIHQLCQEKPRVKKRKGKFRKSRLKLKDGNRISLPSDFQHKFTVQASPTMDKRKSLINSRSSPPASPTIIPRLRAIQLTPGESSKTWGRSSVVPKEEGEEEEKRAPKKKGRTWGPGTLGQKELASGDEGSPQRREKANGLSTPSESPHFHLGLKSLVDGYKQWSSSAPNLVKGPRSSPALPGFTSLMEMEDEDSEGPGSGESRLQHSPSQSYLCIPFPRGEDGDGPSSDGIHEEPTPVNSATSTPQLTPTNSLKRGGAHHRRCEVALLGCGAVLAATGLGFDLLEAGKCQLLPLEEPEPPAREEKKRREGLFQRSSRPRRSTSPPSRKLFKKEEPMLLLGDPSASLTLLSLSSISECNSTRSLLRSDSDEIVVYEMPVSPVEAPPLSPCTHNPLVNVRVERFKRDPNQSLTPTHVTLTTPSQPSSHRRTPSDGALKPETLLASRSPSSNGLSPSPGAGMLKTPSPSRDPGEFPRLPDPNVVFPPTPRRWNTQQDSTLERPKTLEFLPRPRPSANRQRLDPWWFVSPSHARSTSPANSSSTETPSNLDSCFASSSSTVEERPGLPALLPFQAGPLPPTERTLLDLDAEGQSQDSTVPLCRAELNTHRPAPYEIQQEFWS

SEQ ID NO: 54007 - protein, 833 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRLECSGTISPHCNLLLPGSSNSPASASRVAGITGL

SEQ ID NO: 54008 - protein, 821 aa, Homo sapiens
MDVVDPDIFNRDPRDHYDLLQRLGGGTYGEVFKARDKVSGDLVALKMVKMEPDDDVSTLQKEILILKTCRHANIVAYHGSYLWLQKLWICMEFCGAGSLQDIYQVTGSLSELQISYVCREVLQGLAYLHSQKKIHRDIKGANILINDAGEVRLADFGISAQIGATLARRLSFIGTPYWMAPEVAAVALKGGYNELCDIWSLGITAIELAELQPPLFDVHPLRVLFLMTKSGYQPPRLKEKGKWSAAFHNFIKVTLTKSPKKRPSATKMLSHQLVSQPGLNRGLILDLLDKLKNPGKGPSIGDIEDEEPELPPAIPRRIRSTHRSSSLGIPDADCCRRHMEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMLFPSRTTWVYSINNVLMSLSGKTPHLYSHSILGLLERKETRAGNPIAHISPHRLLARKNMVSTKIQDTKGCRACCVAEGASSGGPFLCGALETSVVLLQWYQPMNKFLLVRQVLFPLPTPLSVFALLTGPGSELPAVCIGVSPGRPGKSVLFHTVRFGALSCWLGEMSTEHRGPVQVTQVEEDMVMVLMDGSVKLVTPEGSPVRGLRTPEIPMTEAVEAVAMVGGQLQAFWKHGVQVWALGSDQLLQELRDPTLTFRLLGSPRPVVVETRPVDDPTAPSNLYIQE

SEQ ID NO: 54009 - protein, 239 aa, Homo sapiens
MEFRKLRGMETRPPANTARLQPPRDLRSSSPRKQLSESSDDDYDDVDIPTPAEDTPPPLPPKPKFRSPSDEGPGSMGDDGQLSPGVLVRCASGPPPNSPRPGPPPSTSSPHLTAHSEPSLWNPPSRELDKPPLLPPKKEKMKRKGCALLVKLFNGCPLRIHSTAAWTHPSTKDQHLLLGAEEGIFILNRNDQEATLEMERPPTCILIASLACWNGKRPEQETPSLTLAPTAYWQGTSSQ

SEQ ID NO: 54010 - protein, 833 aa, Homo sapiens; identical to SEQ ID NO: 54007

SEQ ID NO: 54011 - protein, 820 aa, Homo sapiens
MALLRDVSLQDPRDRFELLQRVGAGTYGDVYKARDTVTSELAAVKIVKLDPGDDISSLQQEITILRECRHPNVVAYIGSYLRNDRLWICMEFCGGGSLQEIYHATGPLEERQIAYVCREALKGLHHLHSQGKIHRDIKGANLLLTLQGDVKLADFGVSGELTASVAKRRSFIGTPYWMAPEVAAVERKGGYNELCDVWALGITAIELGELQPPLFHLHPMRALMLMSKSSFQPPKLRDKTRWTQNFHHFLKLALTKNPKKRPTAEKLLQHPFTTQQLPRALLTQLLDKASDPHLGTPSPEDCELETYDMFPDTIHSRGQHGPAERTPSEIQFHQVKFGAPRRKETDPLNEPWEEEWTLLGKEELSGSLLQSVQEALEERSLTIRSASEFQELDSPDDTMGTIKRAPFLGPLPTDPPAEEPLSSPPGTLPPPPSGPNSSPLLPTAWATMKQREDPERSSCHGLPPTPKVHMGACFSKVFNGCPLRIHAAVTWIHPVTRDQFLVVGAEEGIYTLNLHELHEDTLEKLISHRCSWLYCVNNVLLSLSGKSTHIWAHDLPGLFEQRRLQQQVPLSIPTNRLTQRIIPRRFALSTKIPDTKGCLQCRVVRNPYTGATFLLAALPTSLLLLQWYEPLQKFLLLKNFSSPLPSPAGMLEPLVLDGKELPQVCVGAEGPEGPGCRVLFHVLPLEAGLTPDILIPPEGIPGSAQQVIQVDRDTILVSFERCVRIVNMQGEPTATLAPELTFDFPIETVVCLQDSVLAFWSHGMQGRSLDTNEVTQEITDETRIFRVLGAHRDIILESIPTDNPEAHSNLYILTGHQSTY

SEQ ID NO: 54012 - protein, 846 aa, Homo sapiens
MEAPLRPAADILRRNPQQDYELVQRVGSGTYGDVYKARNVHTGELAAVKIIKLEPGDDFSLIQQEIFMVKECKHCNIVAYFGSYLSREKLWICMEYCGGGSLQDIYHVTGPLSELQIAYVCRETLQGLAYLHTKGKMHRDIKGANILLTDHGDVKLADFGVAAKITATIAKRKSFIGTPYWMAPEVAAVEKNGGYNQLCDIWAVGITAIELGELQPPMFDLHPMRALFLMSKSNFQPPKLKDKTKWSSTFHNFVKIALTKNPKKRPTAERLLTHTFVAQPGLSRALAVELLDKVNNPDNHAHYTEADDDDFEPHAIIRHTIRSTNRNARAERTASEINFDKLQFEPPLRKETEARDEMGLSSDPNFMLQWNPFVDGANTGKSTSKRAIPPPLPPKPRISSYPEDNFPDEEKASTIKHCPDSESRAPQILRRQSSPSCGPVAETSSIGNGDGISKLMSENTEGSAQAPQLPRKKDKRDFPKPAINGLPPTPKVLMGACFSKVFDGCPLKINCATSWIHPDTKDQYIIFGTEDGIYTLNLNELHEATMEQLFPRKCTWLYVINNTLMSLSVGKTFQLYSHNLIALFEHAKKPGLAAHIQTHRFPDRILPRKFALTTKIPDTKGCHKCCIVRNPYTGHKYLCGALQSGIVLLQWYEPMQKFMLIKHFDFPLPSPLNVFEMLVIPEQEYPMVCVAISKGTESNQVVQFETINLNSASSWFTEIGAGSQQLDSIHVTQLERDTVLVCLDKFVKIVNLQGKLKSSKKLASELSFDFRIESVVCLQDSVLAFWKHGMQGKSFKSDEVTQEISDETRVFRLLGSDRVVVLESRPTENPTAHSNLYILAGHENSY

SEQ ID NO: 54013 - protein, 232 aa, Homo sapiens
MATAESRALQFAEGAAFPAYRAPHAGGALLPPPSPAAALLPAPPAGPGPATFAGFLGRDPGPAPPPPASLGSPAPPKGAAAPSASQRRKRTSFSAEQLQLLELVFRRTRYPDIHLRERLAALTLLPESRIQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 54014 - protein, 240 aa, Homo sapiens
MATAESRALQFAEGAAFPAYRAPHAGGALLPPPSPAAALLPAPPAGPGPATFAGFLGRDPGPAPPPPASLGSPAPPKGAAAPSASQRRKRTSFSAEQLQLLELVFRRTRYPDIHLRERLAALTLLPESRIQLLFSPLFQVWFQNRRAKSRRQSGKSFQPLARPEIILNHCAPGTETKCLKPQLPLEVDVNCLPEPNGVGGGISDSSSQGQNFETCSPLSEDIGSKLDSWEEHIFSAFGNF

SEQ ID NO: 54015 - protein, 293 aa, Homo sapiens
MATFSGPAGPILSLNPQEDVEFQKEVAQVRKRITQRKKQEQLTPGVVYVRHLPNLLDETQIFSYFSQFGTVTRFRLSRSKRTGNSKGYAFVEFESEDVAKIVAETMNNYLFGERLLECHFMPPEKVHKELFKDWNIPFKQPSYPSVKRYNRNRTLTQKLRMEERFKKKERLLRKKLAKKGIDYDFPSLILQKTESISKTNRQTSTKGQVLRKKKKKVSGTLDTPEKTVDSQGPTPVCTPTFLERRKSQVAELNDDDKDDEIVFKQPISCVKEEIQETQTPTHSRKKRRRSSNQ

SEQ ID NO: 54016 - protein, 418 aa, Homo sapiens
MAPRGRRRPRPHRSEGARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMISDIEKKRQRMIEVQDELLRLEPQLKQLQTKYDELKERKSSLRNAAYFLSNLKQLYQDYSDVQAQEPNVKETYDSSSLPALLFKARTLLGAESHLRNINHQLEKLLDQG

SEQ ID NO: 54017 - protein, 320 aa, Homo sapiens
MAPRGRRRPRPHRSEGARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKVRATAETTTNKI

SEQ ID NO: 54018 - protein, 320 aa, Homo sapiens [sequence omitted]

SEQ ID NO: 54019 - protein, 337 aa, Homo sapiens
MAPRGRRRPRPHRSEGARRSKNTLERTHSMKDKAGQKCKPIDVFDFPDNSDVSSIGRLGENEKDEETYETFDPPLHSTAIYADEEEFSKHCGLSLSSTPPGKEAKRSSDTSGNEASEIESVKISAKKPGRKLRPISDDSESIEESDTRRKVKSAEKISTQRHEVIRTTASSELSEKPAESVTSKKTGPLSAQPSVEKENLAIESQSKTQKKGKISHDKRKKSRSKAIGSDTSDIVHIWCPEGMKTSDIKELNIVLPEFEKTHLEHQQRIESKVCKAAIATFYVNVKEQFIKMLKESQMLTNLKRKNAKMISDIEKKRQRMIEVQDELLRLWTGAGLW

SEQ ID NO: 54020 - protein, 919 aa, Homo sapiens
MAADVFMCSPRRPRSRGRQVLLKPQVSEDDDDSDTDEPSPPPASGAATPARAHASAAPPPPRAGPGREEPPRRQQIIHSGHFMVSSPHREHPPKKGYDFDTVNKQTCQTYSFGKTSSCHLSIDASLTKLFECMTLAYSGKLVSPKWKNFKGLKLQWRDKIRLNNAIWRAWYMQYLEKRKNPVCHFVTPLDGSVDVDEHRRPEAITTEGKYWKSRIEIVIREYHKWRTYFKKRLQQHKDEDLSSLVQDDDMLYWHKHGDGWKTPVPMEEDPLLDTDMLMSEFSDTLFSTLSSHQPVAWPNPREIAHLGNADMIQPGLIPLQPNLDFMDTFEPFQDLFSSSRSIFGSMLPASASAPVPDPNNPPAQESILPTTALPTVSLPDSLIAPPTAPSLAHMDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 54021 - protein, 218 aa, Homo sapiens
MDEQGCEHTSRTEDPFIQPTDFGPSEPPLSVPPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPGEPGGETQCGAPPDPEGCFPIPKAFKLVTTTTTLVCTCMRTHIHLNETKVS

SEQ ID NO: 54022 - protein, 526 aa, Homo sapiens
MDEQGCEHTSRTEDPFIQPTDFGPSEPPLSVPQPFLPVFTMPLLSPSPAPPPISPVLPLVPPPATALNPPAPPTFHQPQKFAGVNKAPSVITHTASATLTHDAPATTFSQSQGLVITTHHPAPSAAPCGLALSPVTRPPQPRLTFVHPKPVSLTGGRPKQPHKIVPAPKPEPVSLVLKNARIAPAAFSGQPQAVIMTSGPLKREGMLASTVSQSNVVIAPAAIARAPGVPEFHSSILVTDLGHGTSSPPAPVSRLFPSTAQDPLGKGEQVPLHGGSPQVTVTGPSRDCPNSGQASPCASEQSPSPQSPQNNCSGKSDPKNVAALKNRQMKHISAEQKRRFNIKMCFDMLNSLISNNSKLTSHAITLQKTVEYITKLQQERGQMQEEARRLREEIEELNATIISCQQLLPATGVPVTRRQFDHMKDMFDEYVKTRTLQNWKFWIFSIIIKPLFESFKGMVSTSSLEELHRTALSWLDQHCSLPILRPMVLSTLRQLSTSTSILTDPAQLPEQASKAVTRIGKRLGES

SEQ ID NO: 54023 - protein, 852 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 54024 - protein, 831 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 54025 - protein, 759 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIELPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 54026 - protein, 850 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKNRRITHISAEQKRRFNIKLGFDTLHGLVSTLSAQPSLKVSKATTLQKTAEYILMLQQERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 54027 - protein, 833 aa, Homo sapiens
MAGALAGLAAGLQVPRVAPSPDSDSDTDSEDPSLRRSAGGLLRSQVIHSGHFMVSSPHSDSLPRRRDQEGSVGPSDFGPRSIDPTLTRLFECLSLAYSGKLVSPKWKNFKGLKLLCRDKIRLNNAIWRAWYIQYVKRRKSPVCGFVTPLQGPEADAHRKPEAVVLEGNYWKRRIEVVMREYHKWRIYYKKRLRKPSREDDLLAPKQAEGRWPPPEQWCKQLFSSVVPVLLGDPEEEPGGRQLLDLNCFLSDISDTLFTMTQSGPSPLQLPPEDAYVGNADMIQPDLTPLQPSLDDFMDISDFFTNSRLPQPPMPSNFPEPPSFSPVVDSLFSSGTLGPEVPPASSAMTHLSGHSRLQARNSCPGPLDSSAFLSSDFLLPEDPKPRLPPPPVPPPLLHYPPPAKVPGLEPCPPPPFPPMAPPTALLQEEPLFSPRFPFPTVPPAPGVSPLPAPAAFPPTPQSVPSPAPTPFPIELLPLGYSEPAFGPCFSMPRGKPPAPSPRGQKASPPTLAPATASPPTTAGSNNPCLTQLLTAAKPEQALEPPLVSSTLLRSPGSPQETVPEFPCTFLPPTPAPTPPRPPPGPATLAPSRPLLVPKAERLSPPAPSGSERRLSGDLSSMPGPGTLSVRVSPPQPILSRGRPDSNKTENRRITHISAEQKRRFNIKLGFDTLHGLVSTLSAQPSLKERAGLQEEAQQLRDEIEELNAAINLCQQQLPATGVPITHQRFDQMRDMFDDYVRTRTLHNWKFWVFSILIRPLFESFNGMVSTASVHTLRQTSLAWLDQYCSLPALRPTVLNSLRQLGTSTSILTDPGRIPEQATRAVTEGTLGKPL

SEQ ID NO: 54028 - protein, 352 aa, Homo sapiens
MNTIVFNKLSGAVLFEDGGASERERGGRPYSGVLDSPHARPEVGIPDGPPLKDNLGLRHRRTGARQNGGKVRHKRQALQDMARPLKQWLYKHRDNPYPTKTEKILLALGSQMTLVQVSNWFANARRRLKNTVRQPDLSWALRIKLYNKYVQGNAERLSVSSDDSCSEDGENPPRTHMNEGGYNTPVHHPVIKSENSVIKAGVRPESRASEDYVAPPKYKSSLLNRYLNDSLRHVMATNTTMMGKTRQRNHSGSFSSNEFEEELVSPSSSETEGNFVYRTDTLENGSNKGESAANRKGPSKDDTYWKEINAAMALTNLAQGKDKLQGTTSCIIQKSSHIAEVKTVKVPLVQQF

SEQ ID NO: 54029 - protein, 352 aa, Homo sapiens; identical to SEQ ID NO: 54028

SEQ ID NO: 54030 - protein, 58 aa, Homo sapiens
MNTIVFNKLSGAVLFEDGGASERERGGRPYSGVLDSPHARPEVGIPDGPPLKDNLGLR

SEQ ID NO: 54031 - protein, 95 aa, Homo sapiens
MNFDFPFKKGSGIPLLTTNLSPQCLSLLHAMVAYDPDERIAAHQALQHPYFQEQRTQNGSEDEASAVLLPIQTRSSLNPLLSTCMLPGRSVTLLV

SEQ ID NO: 54032 - protein, 419 aa, Homo sapiens
MKNYKAIGKIGEGTFSEVMKMQSLRDGNYYACKQMKQRFESIEQVNNLREIQALRRLNPHPNILMLHEVVFDRKSGSLALICELMDMNIYELIRGRRYPLSEKKIMHYMYQLCKSLDHIHRNGIFHRDVKPENILIKQDVLKLGDFGSCRSVYSKQPYTEYISTRWYRAPECLLTDGFYTYKMDLWSAGCVFYEIASLQPLFPGVNELDQISKIHDVIGTPAQKILTKFKQSRAMNFDFPFKKGSGIPLLTTNLSPQCLSLLHAMVAYDPDERIAAHQALQHPYFQEQRKTEKRALGSHRKAGFPEHPVAPEPLSNSCQISKEGRKQKQSLKQEEDRPKRRGPAYVMELPKLKLSGVVRLSSYSSPTLQSVLGSGTNGRVPVLRPLKCIPASKKTDPQKDLKPAPQQCRLPTIVRKGGR

SEQ ID NO: 54033 - protein, 888 aa, Homo sapiens
MAGAAAESGRELWTFAGSRDPSAPRLAYGYGPGSLRELRAREFSRLAGTVYLDHAGATLFSQSQLESFTSDLMENTYGNPHSQNISSKLTHDTVEQVRYRILAHFHTTAEDYTVIFTAGSTAALKLVAEAFPWVSQGPESSGSRFCYLTDSHTSVVGMRNVTMAINVISTPVRPEDLWSAEERSASASNPDCQLPHLFCYPAQSNFSGVRYPLSWIEEVKSGRLHPVSTPGKWFVLLDAASYVSTSPLDLSAHQADFVPISFYKIFGFPTGLGALLVHNRAAPLLRKTYFGGGTASAYLAGEDFYIPRQSVAQRFEDGTISFLDVIALKHGFDTLERLTGGMENIKQHTFTLAQYTYVALSSLQYPNGAPVVRIYSDSEFSSPEVQGPIINFNVLDDKGNIIGYSQVDKMASLYNIHLRTGCFCNTGACQRHLGISNEMVRKHFQAGHVCGDNMDLIDGQPTGSVRISFGYMSTLDDVQAFLRFIIDTRLHSSGDWPVPQAHADTGETGAPSADSQADVIPAVMGRRSLSPQEDALTGSRVWNNSSTVNAVPVAPPVCDVARTQPTPSEKAAGVLEGALGPHVVTNLYLYPIKSCAAFEVTRWPVGNQGLLYDRSWMVVNHNGVCLSQKQEPRLCLIQPFIDLRQRIMVIKAKGMEPIEVPLEENSERTQIRQSRVCADRVSTYDCGEKISSWLSTFFGRPCHLIKQSSNSQRNAKKKHGKDQLPGTMATLSLVNEAQYLLINTSSILELHRQLNTSDENGKEELFSLKDLSLRFRANIIINGKRAFEEEKWDEISIGSLRFQVLGPCHRCQMICIDQQTGQRNQHVFQKLSESRETKVNFGMYLMHASLDLSSPCFLSVGSQVLPVLKENVEGHDLPASEKHQDVTS

SEQ ID NO: 54034 - protein, 620 aa, Homo sapiens
MAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 54035 - protein, 636 aa, Homo sapiens
MAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 54036 - protein, 151 aa, Homo sapiens
MPFDGNKWNFKKMVSYKEMLDTVRQQWPELEKVPEEESSTAKAFKIPGFQGQISFITSILTVARSCWPLFLWPPSSETGCAHMGHSPKDSCQTTQPTPGPVHGCSTHPSLFWSISGKEKLMIDCLHPHSAQIKLRCQLCRCKNEDTVWVGH

SEQ ID NO: 54037 - protein, 356 aa, Homo sapiens
MWKSWKLRTDVREVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGG

SEQ ID NO: 54038 - protein, 385 aa, Homo sapiens
MWKSWKLRTDVRVREGAGGSPCASSQPGSRGPCFLPGLSSQEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGG

SEQ ID NO: 54039 - protein, 385 aa, Homo sapiens
MAARPLSRMLRRLLRSSARSCSSGAPVTQPCPGESARAASEEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIGG

SEQ ID NO: 54040 - protein, 533 aa, Homo sapiens
MPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 54041 - protein, 636 aa, Homo sapiens
MWKSWKLRTDVRVREGAGGSPCASSQPGSRGPCFLPGLSSQEVSRRRQFLREHAAPFSAFLTDSFGRQHSYLRISLTEKCNLRCQYCMPEEGVPLTPKANLLTTEEILTLARLFVKEGIDKIRLTGGEPLIRPDVVDIVAQLQRLEGLRTIGVTTNGINLARLLPQLQKAGLSAINISLDTLVPAKFEFIVRRKGFHKVMEGIHKAIELGYNPVKVNCVVMRGLNEDELLDFAALTEGLPLDVRFIEYMPFDGNKWNFKKMVSYKEMLDTVRQQWPELEKVPEEESSTAKAFKIPGFQGQISFITSMSEHFCGTCNRLRITADGNLKVCLFGNSEVSLRDHLRAGASEQELLRIIGAAVGRKKRQHAGMFSISQMKNRPMILIELFLMFPNSPPANPSIFSWDPLHVQGLRPRMSFSSQVATLWKGCRVPQTPPLAQQRLGSGSFQRHYTSRADSDANSKCLSPGSWASAAPSGPQLTSEQLTHVDSEGRAAMVDVGRKPDTERVAVASAVVLLGPVAFKLVQQNQLKKGDALVVAQLAGVQAAKVTSQLIPLCHHVALSHIQVQLELDSTRHAVKIQASCRARGPTGVEMEALTSAAVAALTLYDMCKAVSRDIVLEEIKLISKTGGQRGDFHRA

SEQ ID NO: 54042 - protein, 356 aa, Homo sapiens; identical to SEQ ID NO: 54037

SEQ ID NO: 54043 - protein, 88 aa, Homo sapiens
MVPLCQVEVLYFAKSAEITGVRSETISVPQEIKALQLWKEIETRHPGLADVRNQIIFAVRQEYVELGDQLLVLQPGDEIAVIPPISGG

SEQ ID NO: 54044 - protein, 188 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSYAIDTLKAKVPIWKKEIYEESSTWKGNKECFWASNS

SEQ ID NO: 54045 - protein, 88 aa, Homo sapiens; identical to SEQ ID NO: 54043

SEQ ID NO: 54046 - protein, 88 aa, Homo sapiens; identical to SEQ ID NO: 54043

SEQ ID NO: 54047 - protein, 88 aa, Homo sapiens; identical to SEQ ID NO: 54043

SEQ ID NO: 54048 - protein, 153 aa, Homo sapiens
MSSLEISSSCFSLETKLPLSPPLVEDSAFEPSRKDMDEVEEKSKDVINFTAEKLSVDEVSQLVISPLCGAISLFVGTTRNNFEGKKVISLEYEAYLPMAENEVRKICSDIRQKWPVKHIAVFHRLGLVPVSEASIIIAVSSAHRAASLEAVSY

SEQ ID NO: 54049 - protein, 547 aa, Homo sapiens
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSQRKHVFVLSEAGKPIYSRYGSVEALSATMGVMTALVSFVQSAGDAIRAIYAEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLARPLRDALGALLRRCTAPGLALSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 54050 - protein, 145 aa, Homo sapiens
MEVGGDTAAPAPGGAEDLEDTQFPSEEAREGGGVHAVPPDPEDEGLEETGSKDKDQPPSPSPPPQSEALSSTSRLWSPAAPENSPTCSPESSSGGQGGDPSDEEWRSQRNGCRTCTTACMLVSTAPPDPCASFTTWLRRRHYWPG

SEQ ID NO: 54051 - protein, 438 aa, Homo sapiens
MEVGGDTAAPAPGGAEDLEDTQFPSEEAREGGGVHAVPPDPEDEGLEETEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLARPLRDALGALLRRCTAPGLALSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 54052 - protein, 401 aa, Homo sapiens
MVSGQLRFGVKTEDHKLVFLQQGPLLLVAMSRTSQSAAQLRGELLAVHAQIVSTLTRASVARIFAHKQNYDLRRLLAGSERTLDRLLDSMEQDPGALLLGAVRCVPLARPLRDALGALLRRCTAPGLALSVLAVGGRLITAAQERNVLAECRLDPADLQLLLDWVGAPAFAAGEAWAPVCLPRFNPDGFFYAYVARLDAMPVCLLLLGTQREAFHAMAACRRLVEDGMHALGAMRALGEAASFSNASSASAPAYSVQAVGAPGLRHFLYKPLDIPDHHRQLPQFTSPELEAPYSREEERQRLSDLYHRLHARLHSTSRPLRLIYHVAEKETLLAWVTSKFELYTCLSPLVTKAGAILVVTKLLRWVKKEEDRLFIRYPPKYSTPPATSTDQAAHNGLFTGL

SEQ ID NO: 54053 - protein, 527 aa, Homo sapiens
MENQEKASIAGHMFDVVVIGGGISGLSAAKLLTEYGVSVLVLEARDRVGGRTYTIRNEHVDYVDVGGAYVGPTQNRILRLSKELGIETYKVNVSERLVQYVKGKTYPFRGAFPPVWNPIAYLDYNNLWRTIDNMGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 54054 - protein, 394 aa, Homo sapiens
MGKEIPTDAPWEAQHADKWDKMTMKELIDKICWTKTARRFAYLFVNINVTSEPHEVSALWFLWYVKQCGGTTRIFSVTNGGQERKFVGGSGQVSERIMDLLGDQVKLNHPVTHVDQSSDNIIIETLNHEHYECKYVINAIPPTLTAKIHFRPELPAERNQLIQRLPMGAVIKCMMYYKEAFWKKKDYCGCMIIEDEDAPISITLDDTKPDGSLPAIMGFILARKADRLAKLHKEIRKKKICELYAKVLGSQEALHPVHYEEKNWCEEQYSGGCYTAYFPPGIMTQYGRVIRQPVGRIFFAGTETATKWSGYMEGAVEAGERAAREVLNGLGKVTEKDIWVQEPESKDVPAVEITHTFWERNLPSVSGLLKIIGFSTSVTALGFVLYKYKLLPRS

SEQ ID NO: 54055 - protein, 520 aa, Homo sapiens
MSNKCDVVVVGGGISGMAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 54056 - protein, 504 aa, Homo sapiens
MAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEPVHYEEKNWCEEQYSGGCYTTYFPPGILTQYGRVLRQPVDRIYFAGTETATHWSGYMEGAVEAGERAAREILHAMGKIPEDEIWQSEPESVDVPAQPITTTFLERHLPSVPGLLRLIGLTTIFSATALGFLAHKRGLLVRV

SEQ ID NO: 54057 - protein, 411 aa, Homo sapiens
MAAAKLLHDSGLNVVVLEARDRVGGRTYTLRNQKVKYVDLGGSYVGPTQNRILRLAKELGLETYKVNEVERLIHHVKGKSYPFRGPFPPVWNPITYLDHNNFWRTMDDMGREIPSDAPWKAPLAEEWDNMTMKELLDKLCWTESAKQLATLFVNLCVTAETHEVSALWFLWYVKQCGGTTRIISTTNGGQERKFVGGSGQVSERIMDLLGDRVKLERPVIYIDQTRENVLVETLNHEMYEAKYVISAIPPTLGMKIHFNPPLPMMRNQMITRVPLGSVIKCIVYYKEPFWRKKDYCGTMIIDGEEAPVAYTLDDTKPEGNYAAIMGFILAHKARKLARLTKEERLKKLCELYAKVLGSLEALEGSTPASGQDLLCRHRDCHTLERLHGGGCRGRGESSPRDPACHGEDSRG

SEQ ID NO: 54058 - protein, 246 aa, Homo sapiens
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 54059 - protein, 270 aa, Homo sapiens
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERTGSCVQFLRGEACPKAGTACLPARYKLVELLCYVVMGFFPALVILSMPNTEGIWELVTGGVFYCLGMVFFKSDGRIPFAHAIWHLFVAFGAGTHYYAIWRYLYLPSTLQTKVSK

SEQ ID NO: 54060 - protein, 193 aa, Homo sapiens
MFAPRLLDFQKTKYARFMNHRVPAHKRYQPTEYEHAANCATHAFWIIPSILGSSNLYFLSDDDWETISAWIYGLGLCGLFVVSTVFHTISWKKSHLRMVEHCLHMFDRMVIYFFIAASYAPWLNLRELGPWASHMRWLVWIMASVGTIYVFFFHERYKLVELLCYVVMGFFPALVILSMAGKLRPGMTCLKRQ

SEQ ID NO: 54061 - protein, 313 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 54062 - protein, 303 aa, Homo sapiens
MPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 54063 - protein, 303 aa, Homo sapiens; identical to SEQ ID NO: 54062

SEQ ID NO: 54064 - protein, 283 aa, Homo sapiens
METGPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 54065 - protein, 77 aa, Homo sapiens
MPEESSPRRTPQSIPYQDLPHLVNADGQYLFCRYWKPTGTPKALIFVSHGAGEHSGRYEELARMLMGLDLLVFAHDH

SEQ ID NO: 54066 - protein, 313 aa, Homo sapiens
MKTRPEDPSSMPEESSPRRTPQSIPYQDLPHLVNADGQYLFCRYWKPTGTPKALIFVSHGAGEHSGRYEELARMLMGLDLLVFAHDHVGHGQSEGERMVVSDFHVFVRDVLQHVDSMQKDYPGLPVFLLGHSMGGAIAILTAAERPGHFAGMVLISPLVLANPESATTFKVLAAKVLNLVLPNLSLGPIDSSVLSRNKTEVDIYNSDPLICRAGLKVCFGIQLLNAVSRVERALPKLTVPFLLLQGSADRLCDSKGAYLLMELAKSQDKTLKIYEGAYHVLHKELPEVTNSVFHEINMWVSQRTATAGTASPP

SEQ ID NO: 54067 - protein, 613 aa, Homo sapiens
MCCWPLLLLWGLLPGTAAGGSGRTYPHRTLLDSEGKYWLGWSQRGSQIAFRLQVRTAGYVGFGFSPTGAMASADIVVGGVAHGRPYLQDYFTNANRELKKDAQQDYHLEYAMENSTHTIIEFTRELHTCDINDKSITDSTVRVIWAYHHEDAGEAGPKYHDSNRGTKSLRLLNPEKTSVLSTALPYFDLVNQDVPIPNKDTTYWCQMFKIPVFQEKHHVIKVEPVIQRGHESLVHHILLYQCSNNFNDSVLESGHECYHPNMPDAFLTCETVIFAWAIGGEGFSYPPHVGLSLGTPLDPHYVLLEVHYDNPTYEEGLIDNSGLRLFYTMDIRKYDAGVIEAGLWVSLFHTIPPGMPEFQSEGHCTLECLEEALEAEKPSGIHVFAVLLHAHLAGRGIRLRHFRKGKEMKLLAYDDDFDFNFQEFQYLKEEQTILPGDNLITECRYNTKDRAEMTWGGLSTRSEMCLSYLLYYPRINLTRCASIPDIMEQLQFIGVKEIYRPVTTWPFIIKSPKQYKNLSFMDAMNKFKWTKKEGLSFNKLVLSLPVNVRCSKTDNAEWSIQGMTALPPDIERPYKAEPLVCGTSSSSSLHRDFSINLLVCLLLLSCTLSTKSL

SEQ ID NO: 54068 - protein, 984 aa, Homo sapiens
MDDRYPALQRAQLRLDFIHANSTTHSFLFGALAELLDNARDAGAERLDVFSVDNEKLQGGFMLCFLDDGCGMSPEEASDIIYFGRSKKRLSTLKFIGQYGNGLKSGSMRIGKDFILFTKKEETMTCVFFSQTFCEEESLSEVVVPMPSWLIRTRESVTDDPQKFAMELSIIYKYSPFKTEAELMQQFDVIYGKCGTLLVIYNLKLLLNGEPELDVKTDKEDILMAGALEDFPARWSFRAYTSVLYFNPWMRIFIQAKRVKTKHLCYCLYRPRKYLYVTSSFKGAFKDEVKKAEEAVKIAESILKEAQIKVNQCDRTSLSSAKDVLQRALEDVEAKQKNLKEKQRELKTARTLSLFYGVNVENRSQAGMFIYSNNRLIKMHEKVGSQLKLKSLLGAGVVGIVNIPLEVMEPSHNKQEFLNVQEYNHLLKVMGQYLVQYCKDTGINNRNLTLFCNEFGYQNDIDVEKPLNSFQYQRRQAMGIPFIIQCDLCLKWRVLPSSTNYQEKEFFDIWICANNPNRLENSCHQVECLPSIPLGTMSTISPSKNEKEKQLRESVIKYQNRLAEQQPQPQFIPVDEITVTSTCLTSAHKENTKTQKIRLLGDDLKHESLSSFELSASRRGQKRNIEETDSDVEYISETKIMKKSMEEKMNSQQQRIPVALPENVKLAERSQRSQIANITTVWRAQPTEGCLKNAQAASWEMKRKQSLNFVEECKVLTEDENTSDSDIILVSDKSNTDVSLKQEKKEIPLLNQEKQELCNDVLAMKRSSSLPSWKSLLNVPMEDVNLSSGHIARVSVSGSCKVASSPASSQSTPVKETVRKLKSKLREILLYFFPEHQLPSELEEPALSCELEQCPEQMNKKLKMCFNQIQNTYMVQYEKKIKRKLQSIIYDSNTRGIHNEISLGQCENKRKISEDKLKNLRIKLALLLQKLQLGGPEGDLEQTDTYLEALLKEDNLLFQNNLNKVTIDARHRLPLEKNEKTSEN

SEQ ID NO: 54069 - protein, 362 aa, Homo sapiens
MAPKQDPKPKFQEGERVLCFHGPLLYEAKCVKVAIKDKQVKYFIHYSGWNKKSAVRPRRSEKSLKTHEDIVALFPVPEGAPSVHHPLLTSSWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 54070 - protein, 348 aa, Homo sapiens
MIPFPHPQVTDALGRYSNYILSSTVESPSLRSMNFEKQGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 54071 - protein, 323 aa, Homo sapiens
MAPKQDPKPKFQEGERVLCFHGPLLYEAKCVKVAIKDKQVKYFIHYSGWNKNWDEWVPESRVLKYVDTNLQKQRELQKANQEQYAEGKMRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 54072 - protein, 235 aa, Homo sapiens
MRGAAPGKKTSGLQQKNVEVKTKKNKQKTPGNGDGGSTSETPQPPRKKRARVDPTVENEETFMNRVEVKVKIPEELKPWLVDDWDLITRQKQLFYLPAKKNVDSILEDYANYKKSRGNTDNKEYAVNEVVAGIKEYFNVMLGTQLLYKFERPQYAEILADHPDAPMSQVYGAPHLLRLFVRIGAMLAYTPLDEKSLALLLNYLHDFLKYLAKNSATLFSASDYEVAPPEYHRKAV

SEQ ID NO: 54073 - protein, 235 aa, Homo sapiens; identical to SEQ ID NO: 54072

SEQ ID NO: 54074 - protein, 114 aa, Homo sapiens
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAK

SEQ ID NO: 54075 - protein, 115 aa, Homo sapiens
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLSEMLPQHAAK

SEQ ID NO: 54076 - protein, 108 aa, Homo sapiens
MVSRKAVAALLVVHVAAMLASQTEAFVPIFTYGELQRMQEKERNKGQKKSLSVWQRSGEEGPVDPAEPIREEENEMIKLTAPLEIGMRMNSRQLEKYPATLEGLLTAK

SEQ ID NO: 54077 - protein, 412 aa, Homo sapiens
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLLVVVLAFIICWLPFHVGRIIYINTEDSRMMYFSQYFNIVALQLFYLSASINPILYNLISKKYRAAAFKLLLARKSRPRGFHRSRDTAGEVAGDTGGDTVGYTETSANVKTMG

SEQ ID NO: 54078 - protein, 386 aa, Homo sapiens
MGSPWNGSDGPEGAREPPWPALPPCDERRCSPFPLGALVPVTAVCLCLFVVGVSGNVVTVMLIGRYRDMRTTTNLYLGSMAVSDLLILLGLPFDLYRLWRSRPWVFGPLLCRLSLYVGEGCTYATLLHMTALSVERYLAICRPLRARVLVTRRRVRALIAVLWAVALLSAGPFLFLVGVEQDPGISVVPGLNGTARIASSPLASSPPLWLSRAPPPSPPSGPETAEAAALFSRECRPSPAQLGALRVMLWVTTAYFFLPFLCLSILYGLIGRELWSSRRPLRGPAASGRERGHRQTVRVLRKWSRRGSKDACLQSAPPGTAQTLGPLPLLAQLWAPLPAPFPISIPASTRRGGGSGIYNLLVALPRWQNHLHKHGRFADDVLLSVL

SEQ ID NO: 54079 - protein, 401 aa, Homo sapiens
MEKSKNFRIDALLAVDPPRAASAQSAPLALVTSLAAAASGTGGGGGGGGASGGTSGSCSPASSEPPAAPADRLRAESPSPPRLLAAHCALLPKPGFLGAGGGGGGTGGGHGGPHHHAHPGAAAAAAAAAAAAAAGGLALGLHPGGAQGGAGLPAQAALYGHPVYGYSAAAAAAALAGQHPALSYSYPQVQGAHPAHPADPIKLGAGTFQLDQWLRASTAGMILPKMPDFNSQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 54080 - protein, 231 aa, Homo sapiens
AAAALAGQHPALSYSYPQVQGAHPAHPADPIKLGAGTFQLDQWLRASTAGMILPKMPDFNSQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 54081 - protein, 189 aa, Homo sapiens
MGGLSTVGACPGILGAQQAQAQSNLLGKCRRPRTAFTSQQLLELEHQFKLNKYLSRPKRFEVATSLMLTETQVKIWFQNRRMKWKRSKKAKEQAAQEAEKQKGGGGGAGKGGAEEPGAEELLGPPAPGDKGSGRRLRDLRDSDPEEDEDEDDEDHFPYSNGASVHAASSDCSSEDDSPPPRPSHQPAPQ

SEQ ID NO: 54082 - protein, 563 aa, Homo sapiens
MPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPALTACLTLNQNPAELPLQGTGRLGEGVYNPSHSTPSPAGENDTSSC

SEQ ID NO: 54083 - protein, 1003 aa, Homo sapiens
MPSKFSCRQLREAGQCFESFLVVRGLDMETDRERLRTIYNRDFKISFGTPAPGFSSMLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 54084 - protein, 947 aa, Homo sapiens
MLYGMKIANLAYVTKTRVRFFRLDRWADVRFPEKRRMKLGSDISKHHKSLLAKIFYDRAEYLHGKHGVDVEVQGPHEARDGQLLIRLDLNRKEVLTLRLRNGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 54085 - protein, 1003 aa, Homo sapiens; identical to SEQ ID NO: 54083

SEQ ID NO: 54086 - protein, 941 aa, Homo sapiens
METDRERLRTIYNRDFKISFGTPAPGFSSMLYGMKIANLAYVTKTRVRFFRLDRWADVRFPEKRRMKLGSDISKHHKSLLAKIFYDRAEYLHGKHGGTQSVTLTHLFPLCRTPQFAFYNEDQELPCPLGPGECYELHVHCKTSFVGYFPATVLWELLGPGESGSEGAGTFYIARFLAAVAHSPLAAQLKPMTPFKRTRITGNPVVTNRIEEGERPDRAKGYDLELSMALGTYYPPPRLRQLLPMLLQGTSIFTAPKEIAEIKAQLETALKWRNYEVKLRLLLHLEELQMEHDIRHYDLESVPMTWDPVDQNPRLLTLEVPGVTESRPSVLRGDHLFALLSSETHQEDPITYKGFVHKVELDRVKLSFSMSLLSRFVDGLTFKVNFTFNRQPLRVQHRALELTGRWLLWPMLFPVAPRDVPLLPSDVKLKLYDRSLESNPEQLQAMRHIVTGTTRPAPYIIFGPPGTGKTVTLVEAIKQVVKHLPKAHILACAPSNSGADLLCQRLRVHLPSSIYRLLAPSRDIRMVPEDIKPCCNWDAKKGEYVFPAKKKLQEYRVLITTLITAGRLVSAQFPIDHFTHIFIDEAGHCMEPESLVAIAGLMEVKETGDPGGQLVLAGDPRQLGPVLRSPLTQKHGLGYSLLERLLTYNSLYKKGPDGYDPQFITKLLRNYRSHPTILDIPNQLYYEGELQACADVVDRERFCRWAGLPRQGFPIIFHGVMGKDEREGNSPSFFNPEEAATVTSYLKLLLAPSSKKGKARLSPRSVGVISPYRKQVEKIRYCITKLDRELRGLDDIKDLKVGSVEEFQGQERSVILISTVRSSQSFVQLDLDFNLGFLKNPKRFNVAVTRAKALLIIVGNPLLLGHDPDWKVFLEFCKENGGYTGCPFPAKLDLQQGQNLLQGLSKLSPSTSGPHSHDYLPQEREGEGGLSLQVEPEWRNEL

SEQ ID NO: 54087 - protein, 1003 aa, Homo sapiens; identical to SEQ ID NO: 54083

SEQ ID NO: 54088 - protein, 56 aa, Homo sapiens
MPSKFSCRQLREAGQCFESFLVVRGLDMETDRERLRTIYNRDFKISLASSKSILQS

SEQ ID NO: 54089 - protein, 1211 aa, Homo sapiens
MLSLAAKLVAFFWRTADTPREEAGQLEPELAEGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 54090 - protein, 125 aa, Homo sapiens
MSDISGQVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVRPAQARLVL

SEQ ID NO: 54091 - protein, 125 aa, Homo sapiens; identical to SEQ ID NO: 54090

SEQ ID NO: 54092 - protein, 338 aa, Homo sapiens
MFRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRDPCFGALLEYSITNGVYMGCDLPPALQSLQNCGEGVADPSYPVVPESTGPEKHQEPS

SEQ ID NO: 54093 - protein, 1165 aa, Homo sapiens
MLSLAAKLVAFFWRTADTPREEAGQLEPELAEGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTDPCFGALLEYSITNGVYMGCDLPPALQSLQNCGEGVADPSYPVVPESTGPEKHQEPS

SEQ ID NO: 54094 - protein, 211 aa, Homo sapiens
MSFLPVRSVIGGGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVACRLVAPLCASGRPAIRGNLHGPGFSCMCWKPGKIKLCHGQREKK

SEQ ID NO: 54095 - protein, 1165 aa, Homo sapiens
MSFLPVRSVIGGGDTKLKTVRGVVTRYCSDYGMIDDMIYFSSDAVTSRVLLNVGQEVIAVVEENKVSNGLKAIRVEAVSDKWEDDSRNHGSPSDCGPRVLIGCVTSLVEGAGCISQTTYFSLESVCEGFEPCKGDWVEAEYRIRPGTWSSEATSVKPLRYKRVDKVCISSLCGRNGVLEESIFFTLDSLKLPDGYTPRRGDVVNAVVVESSQSCYVWRALCMTLVKRRDAAPVHEATHFYGTILLKNKGDIEVTQVTHFGTLKEGRSKTMVIWIENKGDIPQNLVSCKLAGWDKSKQFRFQMLDKDQMCPVVSFVSVPEKENSSDENINSLNSHTKNKTSQMSESSLVNNRGISPGDCTCKGENGEKDNILSRKQMTEPEPGGLVPPGGKTFIVVICDGKNPGRCKELLLLCFSDFLIGRYLEVNVISGEESLIAAREPFSWKKLKSSQALTSAKTTVVVTAQKRNSRRQLPSFLPQYPIPDRLRKCVEQKIDILTFQPLLAELLNMSNYKEKFSTLLWLEEIYAEMELKEYNMSGIILRRNGDLLVLEVPGLAEGRPSLYAGDKLILKTQEYNGHAIEYISYVTEIHEEDVTLKINPEFEQAYNFEPMDVEFTYNRTTSRRCHFALEHVIHLGVKVLFPEEIILQSPQVTGNWNHAQDTKSSGQSTSKKNRKTMTDQAEHGTEERRVGDKDLPVLAPFTAEMSDWVDEIQTPKARKMEFFNPVLNENQKLAVKRILSGDCRPLPYILFGPPGTGKTVTIIEAVLQVHFALPDSRILVCAPSNSAADLVCLRLHESKVLQPATMVRVNATCRFEEIVIDAVKPYCRDGEDIWKASRFRIIITTCSSSGLFYQIGVRVGHFTHVFVDEAGQASEPECLIPLGLMSDISGQIVLAGDPMQLGPVIKSRLAMAYGLNVSFLERLMSRPAYQRDENAFGACGAHNPLLVTKLVKNYRSHEALLMLPSRLFYHRELEVCADPTVVTSLLGWEKLPKKGFPLIFHGVRGSEAREGKSPSWFNPAEAVQVLRYCCLLAHSISSQVSASDIGVITPYRKQVEKIRILLRNVDLMDIKVGSVEEFQGQEYLVIIISTVRSNEDRFEDDRYFLGFLSNSKRFNVAITRPKALLIVLGNPHVLVRLWRGGGRPLLPSGARIHRTREASGAQLICSG

SEQ ID NO: 54096 - protein, 1211 aa, Homo sapiens; identical to SEQ ID NO: 54089

SEQ ID NO: 54097 - protein, 160 aa, Homo sapiens
MAAERKTRLSKNLLRMKFMQRGLDSETKKQLEEEEKKIISEEHWYLDLPELKEKESFIIEEQSFLLCEDLLYGRMSFRGFNPEVEKLMLQMNAKHKAEEVEDETVELDVSDEEMARRYETLVGTIGKKFARKRDHANYEEDENGDITPIKAKKMFLKPQD

SEQ ID NO: 54098 - protein, 208 aa, Homo sapiens
MKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLTGSRSVVQAGVQWRGLQLTGVLTSQAQAILPPQPPNYLGLKMTVILFTHSALLQVPINSS

SEQ ID NO: 54099 - protein, 860 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLDSHFVYSFSPVAGPNKLFIRLTEAPSAKVKLLIGAYRVQLQ

SEQ ID NO: 54100 - protein, 867 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKNGDYITVKVALNSNEEYNLDQEDSSGMTLVMLAAAGGQDDLLRLLITKGAKVNGRQKNGTTALIHAAEKNFLTTVAILLEAGAFVNVQQSNGETALMKACKRGNSDIVRLVIECGADCNILSKHQNSALHFAKQSNNVLVYDLLKNHLETLSRVAEETIKDYFEARLALLEPVFPIACHRLCEGPDFSTDFNYKPPQNIPEGSGILLFIFHANFLGKEVIARLCGPCSVQAVVLNDKFQLPVFLTGSRSVVQAGVQWRGLQLTGVLTSQAQAILPPQPPNYLGLKMHATTSG

SEQ ID NO: 54101 - protein, 603 aa, Homo sapiens
MEQVAEGARVTAVPVSAADSTEELAEVEEGVGVVGEDNDAAARGAEAFGDSEEDGEDVFEVEKILDMKTEGGKVLYKVRWKGYTSDDDTWEPEIHLEDCKEVLLEFRKKIAENKAKAVRKDIQRLSLNNDIFEANSDSDQQSETKEDTSPKKKKKKLRQREEKSPDDLKKKKAKAGKLKDKSKPDLESSLESLVFDLRTKKRISEAKEELKESKKPKKDEVKETKELKKVKKGEIRDLKTKTREDPKENRKTKKEKFVESQVESESSVLNDSPFPEDDSEGLHSDSREEKQNTKSARERAGQDMGLEHGFEKPLDSAMSAEEDTDVRGRRKKKTPRKAEDTRENRKLENKNAFLEKKTVPKKQRNQDRSKSAAELEKLMPVSAQTPKGRRLSGEERGLWSTDSAEEDKETKRNESKEKYQKRHDSDKEEKGRKEPKGLKTLKEIRNAFDLFKLTPEEKNDVSENNRKREEIPLDFKTIDDHKTKENKQSLKERRNTRDETDTWAYIAAEGDQEVLDSVCQADENSDGRQQILSLGMDLQLEWMKLEDFQKHLDGKDENFAATDAIPSNVLRDAVKKKKKKKFLGTYTFFLFFFFEKPDLVPLF

SEQ ID NO: 54102 - protein, 1028 aa, Homo sapiens
MGFFSLSSERNESVIHYPESTEPEIQQEMSTSQPDCNVDSCSVSSGYGTFCISELNLYKSKDPKEFMEHIDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQTPQICEESSHKCAFAGHYVPCHLYDYRFQG

SEQ ID NO: 54103 - protein, 1031 aa, Homo sapiens
MGFFSLSSERNESVIHYPESTEPEIQQEMSTSQPDCNVDSCSVSSGYGTFCISELNLYKSKDPKEFMEHIDVPKGQYVAPAVPAESLVDGVKNENFYIQTPEECHVSLKEDVSISPGEFEHNFLGENKVSEVYSGKTNSNAITSWAQKLKQNQPKRAHVEDGGSRSKQGNEQSKKTPIEKSDFAAATHPRAFYLSKPDETPNAWMSDSGTGLTYWKLEEKDMHHSLPETLEKTFISLSSTDVSPNQSNTSNEMKLPSLKDIYYKKQRENKQLPERNLTSASNPNHPPEVLTLDPTLHMKPKQQISGIQPHGLPNALDDRISFSPDSVLEPSMSSPSDIDSFSQASNVTSQLPGFPKYPSHTKASPVDSWKNQTFQNESRTSSTFPSVYTITSNDISVNTVDEENTVMVASASVSQSQLPGTANSVPECISLTSLEDPVILSKIRQNLKEKHARHIADLRAYYESEINSLKQKLEAKEISGVEDWKITNQILVDRCGQLDSALHEATSRVRTLENKNNLLEIEVNDLRERFSAASSASKILQERIEEMRTSSKEKDNTIIRLKSRLQDLEEAFENAYKLSDDKEAQLKQENKMFQDLLGEYESLGKEHRRVKDALNTTENKLLDAYTQISDLKRMISKLEAQVKQVEHENMLSLRHNSRIHVRPSRANTLATSDVSRRKWLIPGAEYSIFTGQPLDTQDSNVDNQLEETCSLGHRSPLEKDSSPGSSSTSLLIKKQRETSDTPIMRALKELDEGKIFKNWGTQTEKEDTSNINPRQTETSVNASRSPEKCAQQRQKRLNSASQRSSSLPPSNRKSSTPTKREIMLTPVTVAYSPKRSPKENLSPGFSHLLSKNESSPIRFDILLDDLDTVPVSTLQRTNPRKQLQFLPLDDSEEKTYSEKATDNHVNHSSCPEPVPNGVKKVSVRTAWEKNKSVSYEQCKPVSVTPQGNDFEYTAKIRTLAETERFFDELTKEKDQIEAALSRMPSPGGRITLQTRLNQEALEDRLERINRELGSVRMTLKKFHVLRTSANL

SEQ ID NO: 54104 - protein, 176 aa, Homo sapiens
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 54105 - protein, 120 aa, Homo sapiens
MCHLYEGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 54106 - protein, 176 aa, Homo sapiens; identical to SEQ ID NO: 54104

SEQ ID NO: 54107 - protein, 170 aa, Homo sapiens
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYVGRCPMCCCYLELLPVLEGTSALSLPHSIVSTLQ

SEQ ID NO: 54108 - protein, 113 aa, Homo sapiens
MALWRAYQRALAAHPWKVQVLTAGSLMGLGDIISQQLVERRGLQEHQRGRTLTMVSLGCGFVDYPDALITNYYLWPAVQLANFYLVPLHYRLAVVQCVAVIWNSYLSWKAHRL

SEQ ID NO: 54109 - protein, 191 aa, Homo sapiens
MALWRAYQRALAAHPWKVQVLTAAHPRRCPDNTCVPCIGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 54110 - protein, 115 aa, Homo sapiens
MGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAV

SEQ ID NO: 54111 - protein, 121 aa, Homo sapiens
  MOD_RES (1)..(1): Any amino acid
XSLMGLGDIISQQLVERRGLQEHQRGRTLTMVSLGCGFVGPVVGGWYKVLDRFIPGTTKVDALKKMLLDQDYPDALITNYYLWPAVQLANFYLVPLHYRLAVVQCVAVIWNSYLSWKAHRL

SEQ ID NO: 54112 - protein, 67 aa, Homo sapiens
  MOD_RES (1)..(1): Any amino acid
XDSQGKKTGFTGIKKGDYPDALITNYYLWPAVQLANFYLVPLHYRLAVVQCVAVIWNSYLSWKAHRL

SEQ ID NO: 54113 - protein, 303 aa, Homo sapiens
MAPAADMTSLPLGVKVEDSAFGKPAGGGAGQAPSAAAATAAAMGADEEGAKPKVSPSLLPFSVEALMADHRKPGAKESALAPSEGVQAAGGSAQPLGVPPGSLGAPDAPSSPRPLGHFSVGGLLKLPEDALVKAESPEKPERTPWMQSPRFSPPPARRLSPPACTLRKHKTNRKPRTPFTTAQLLALERKFRQKQYLSIAERAEFSSSLSLTETQVKIWFQNRRAKAKRLQEAELEKLKMAAKPMLPPAAFGLSFPLGGPAAVAAAAGASLYGASGPFQRAALPVAPVGLYTAHVGYSMYHLT

SEQ ID NO: 54114 - protein, 267 aa, Homo sapiens
MASPSKGNDLFSPDEEGPAVVAGPGPGPGGAEGAAEERRVKVSSLPFSVEALMSDKKPPKEASPLPAESASAGATLRPLLLSGHGAREAHSPGPLVKPFETASVKSENSEDGAAWMQEPGRYSPPPRHMSPTTCTLRKHKTNRKPRTPFTTSQLLALERKFRQKQYLSIAERAEFSSSLNLTETQVKIWFQNRRAKAKRLQEAELEKLKMAAKPMLPSSFSLPFPISSPLQAASIYGASYPFHRPVLPIPPVGLYATPVGYGMYHLS

SEQ ID NO: 54115 - protein, 326 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTASSDNLARLWCVETGEIKREYGGHQKAVVCLAFNDSVLG

SEQ ID NO: 54116 - protein, 326 aa, Homo sapiens; identical to SEQ ID NO: 54115

SEQ ID NO: 54117 - protein, 327 aa, Homo sapiens
MNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTGNCYVWNLTGGIGDEVTQLIPKTKIPAHTRYALQCRFSPDSTLLATCSADQTCKIWRTSNFSLMTELSIKSGNPGESSRGWMWGCAFSGDSQYIVTGEPRPGLPHPWPPALASRASPPRLQLPLCWGRLLGLHLRS

SEQ ID NO: 54118 - protein, 217 aa, Homo sapiens
MEHAPWSPGASSRARAGHTMNTSPGTVGSDPVILATAGYDHTVRFWQAHSGICTRTVQHQDSQVNALEVTPDRSMIAAAGYQHIRMYDLNSNNPNPIISYDGVNKNIASVGFHEDGRWMYTGGEDCTARIWDLRSRNLQCQRIFQVNAPINCVCLHPNQAELIVGDQSGAIHIWDLKTDHNEQLIPEPEVSITSAHIDPDASYMAAVNSTAPRHLLG

SEQ ID NO: 54119 - protein, 326 aa, Homo sapiens; identical to SEQ ID NO: 54115

SEQ ID NO: 54120 - protein, 326 aa, Homo sapiens; identical to SEQ ID NO: 54115

SEQ ID NO: 54121 - protein, 490 aa, Homo sapiens
MAQRAVWLISHEPGTPLCGTVRFSRRYPTVEKRARVFNGASYVPVPEDGPFLKALLFELRLLDDDKDFVESRDSCSRINKTSIYGLLIGGEELWPVVAFLKNDMIYACVPLVEQTLSPRPPLISVSGVSQGFEFLFGIQDFLYSGQKNDSELNTKLSQLPDLLLQACPFGTLLDANLQNSLDNTNFASVTQPQKQPAWKTGTYKGKPQVSISITEKVKSMQYDKQGIADTWQVVGTVTCKCDLEGIMPNVTISLSLPTNGSPLQDILVHPCVTSLDSAILTSSSIDAMDDSAFSGPYKFPFTPPLESFNLCFYTSQVPVPPILGFYQMKEEEVQLRITINLKLHESVKNNFEFCEAHIPFYNRGPITHLEYKTSFGQLEVFREKSLLIWIIGQKFPKSMEISLSGTVTFGAKSHEKQPFDPICTGETAYLKLHFRILDYTLTGCYADQHSVQVFASGKPKISAHRKLISSDYYIWNSKAPAPVTYGSLLL

SEQ ID NO: 54122 - protein, 5478 aa, Homo sapiens
MLVIWILTLALRLCASVTTVTPEGSAVHKAISQQGTLWTGEVLEKQTVEQGKSTLRRQKNHFHRSAGELRCRNALKDEGASAGWSVMFAGESVVVLVHLWMTGARVKNLGLVEFASPGDDGDGRAEGFSLGLPLSEQARAAGAREKERQETVINHSTFSGFSQITGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 54123 - protein, 5335 aa, Homo sapiens
MLVIWILTLALRLCASVTTVTPGSTVNTSIGGNTTSASTPSSSDPFTTFSDYGVSVTFITGSTATKHFLDSSTNSGHSEESTVSHSGPGATGTTLFPSHSATSVFVGEPKTSPITSASMETTALPGSTTTAGLSEKSTTFYSSPRSPDRTLSPARTTSSGVSEKSTTSHSRPGPTHTIAFPDSTTMPGVSQESTASHSIPGSTDTTLSPGTTTPSSLGPESTTFHSSPGYTKTTRLPDNTTTSGLLEASTPVHSSTGSPHTTLSPSSSTTHEGEPTTFQSWPSSKDTSPAPSGTTSAFVKLSTTYHSSPSSTPTTHFSASSTTLGHSEESTPVHSSPVATATTPPPARSATSGHVEESTAYHRSPGSTQTMHFPESSTTSGHSEESATFHGSTTHTKSSTPSTTAALAHTSYHSSLGSTETTHFRDSSTISGRSEESKASHSSPDAMATTVLPAGSTPSVLVGDSTPSPISSGSMETTALPGSTTKPGLSEKSTTFYSSPRSPDTTHLPASMTSSGVSEESTTSHSRPGSTHTTAFPGSTTMPGLSQESTASHSSPGPTDTTLSPGSTTASSLGPEYTTFHSRPGSTETTLLPDNTTASGLLEASMPVHSSTRSPHTTLSPAGSTTRQGESTTFHSWPSSKDTRPAPPTTTSAFVEPSTTSHGSPSSIPTTHISARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSERSTTFHSSPRSPATTLSPASTTSSGVSEESTTSRSRPGSTHTTAFPDSTTTPGLSRHSTTSHSSPGSTDTTLLPASTTTSGPSQESTTSHSSSGSTDTALSPGSTTALSFGQESTTFHSNPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSRGSTETTVFPHSTTTSVHGEEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSDLSQEPTTSHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPSSKDTMPAPPTTTSAFVELSTTSHGSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRTPTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTPGLSRHSTTSHSSPGSTDTTLLPASTTTSGPSQESTTSHSSPGSTDTALSPGSTTALSFGQESTTFHSSPGSTHTTLFPDSTTSSGIVEASTRVHSSTGSPRTTLSPASSTSPGLQGESTTFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRGEEPTTFHSRPASTHTTLFTEDSTTSGLTEESTAFPGSPASTQTGLPATLTTADLGEESTTFPSSSGSTGTTLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTASHSSQGSTEATLSPGSTTASSLGQQSTTFHSSPGDTETTLLPDDTITSGLVEASTPTHSSTGSLHTTLTPASSTSAGLQEESTTFQSWPSSSDTTPSPPGTTAAPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSTHTTAFPGSTTMPGVSQESTASHSSPGSTDTTLSPGSTTASSLGPESTTFHSGPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESDTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPRSPATTLSPASTTSSGVSEESTTSHSRPGSTHTTAFPDSTTTPGLSRHSTTSHSSPGSTDTTLLPASTTTSGSSQESTTSHSSSGSTDTALSPGSTTALSFGQESTTFHSSPGSTHTTLFPDSTTSSGIVEASTRVHSSTGSPRTTLSPASSTSPGLQGESTAFQTHPASTHTTPSPPSTATAPVEESTTYHRSPGSTPTTHFPASSTTSGHSEKSTIFHSSPDASGTTPSSAHSTTSGRGESTTSRISPGSTEITTLPGSTTTPGLSEASTTFYSSPRSPTTTLSPASMTSLGVGEESTTSRSQPGSTHSTVSPASTTTPGLSEESTTVYSSSPGSTETTVFPRSTTTSVRREEPTTFHSRPASTHTTLFTEDSTTSGLTEESTAFPGSPASTQTGLPATLTTADLGEESTTFPSSSGSTGTKLSPARSTTSGLVGESTPSRLSPSSTETTTLPGSPTTPSLSEKSTTFYTSPRSPDATLSPATTTSSGVSEESSTSHSQPGSTHTTAFPDSTTTSGLSQEPTTSHSSQGSTEATLSPGSTTASSLGQQSTTFHSSPGDTETTLLPDDTITSGLVEASTPTHSSTGSLHTTLTPASSTSTGLQEESTTFQSWPSSSDTTPSPPSTTAVPVEVSTTYHSRPSSTPTTHFSASSTTLGRSEESTTVHSSPGATGTALFPTRSATSVLVGEPTTSPISSGSTETTALPGSTTTAGLSEKSTTFYSSPRSPDTTLSPASTTSSGVSEESTTSHSRPGSMHTTAFPSSTTMPGVSQESTASHSSPGSTDTTLSPGSTTASSLGPESTTFHSSPGSTETTLLPDNTTASGLLEASTPVHSSTGSPHTTLSPAGSTTRQGESTTFQSWPNSKDTTPAPPTTTSAFVELSTTSHGSPSSTPTTHFSASSTTLGRSEESTTVHSSPVATATTPSPARSTTSGLVEESTTYHSSPGSTQTMHFPESNTTSGRGEESTTSHSSTTHTISSAPSTTSALVEEPTSYHSSPGSTATTHFPDSSTTSGRSEESTASHSSQDATGTIVLPARSTTSVLLGESTTSPISSGSMETTALPGSTTTPGLSEKSTTFHSSPSSTPTTHFSASSTTLGRSEESTTVHSSPVATATTPSPARSTTSGLVEESTAYHSSPGSTQTMHFPESSTASGRSEESRTSHSSTTHTISSPPSTTSALVEEPTSYHSSPGSIATTHFPESSTTSGRSEESTASHSSPDTNGITPLPAHFTTSGRIAESTTFYISPGSMETTLASTATTPGLSAKSTILYSSSRSPDQTLSPASMTSSSISGEPTSLYSQAESTHTTAFPASTTTSGLSQESTTFHSKPGSTETTLSPGSITTSSFAQEFTTPHSQPGSALSTVSPASTTVPGLSEESTTFYSSPGSTETTAFSHSNTMSIHSQQSTPFPDSPGFTHTVLPATLTTTDIGQESTAFHSSSDATGTTPLPARSTASDLVGEPTTFYISPSPTYTTLFPASSSTSGLTEESTTFHTSPSFTSTIVSTESLETLAPGLCQEGQIWNGKQCVCPQGYVGYQCLSPLESFPVETPEKLNATLGMTVKVTYRNFTEKMNDASSQEYQNFSTLFKNRMDVVLKGDNLPQYRGVNIRRLLNGSIVVKNDVILEADYTLEYEELFENLAEIVKAKIMNETRTTLLDPDSCRKAILCYSEEDTFVDSSVTPGFDFQEQCTQKAAEGYTQFYYVDVLDGKLACVNKCTKGTKSQMNCNLGTCQLQRSGPRCLCPNTNTHWYWGETCEFNIAKSLVYGIVGAVMAVLLLALIILIILFSLSQRKRHREQYDVPQEWRKEGTPGIFQKTAIWEDQNLRESRFGLENAYNNFRPTLETVDSGTELHIQRPEMVASTV

SEQ ID NO: 54124 - protein, 511 aa, Homo sapiens
MKAIIHLTLLALLSVNTATNQGNSADAVTTTETATSGPTVAAADTTETNFPETASTTANTPFPTATSPAPPIISTHSSSTIPTPAPPIISTHSSSTIPIPTAADSESTTNVNSLATSDIITASSPNDGLITMVPSETQSNNEMSPTTEDNQSSGPPTGTALLETSTLNSTGPSNPCQDDPCADNSLCVKLHNTSFCLCLEGYYYNSSTCKKGKVFPGKISVTVSETFDPEEKHSMAYQDLHSEITSLFKDVFGTSVYGQTVILTVSTSLSPRSEMRADDKFVNVTIVTILAETTSDNEKTVTEKINKAIRSSSSNFLNYDLTLRCDYYGCNQTADDCLNGLACDCKSDLQRPNPQSPFCVASSLKCPDACNAQHKQCLIKKSGGAPECACVPGYQEDANGNCQKCAFGYSGLDCKDKFQLILTIVGTIAGIVILSMIIALIVTARSNNKTKHIEEENLIDEDFQNLKLRSTGFTNLGAEGSVFPKVRITASRDSQMQNPYSRHSSMPRPDY

SEQ ID NO: 54125 - protein, 4493 aa, Homo sapiens
MPRPGTMALCLLTLVLSLLPPQAAAEQDLSVNRAVWDGGGCISQGDVLNRQCQQLSQHVRTGSAANTATGTTSTNVVEPRMYLSCSTNPEMTSIESSVTSDTPGVSSTRMTPTESRTTSESTSDSTTLFPSSTEDTSSPTTPEGTDVPMSTPSEESISSTMAFVSTAPLPSFEAYTSLTYKVDMSTPLTTSTQASSSPTTPESTTIPKSTNSEGSTPLTSMPASTMKVASSEAITLLTTPVEISTPVTISAQASSSPTTAEGPSLSNSAPSGGSTPLTRMPLSVMLVVSSEASTLSTTPAATNIPVITSTEASSSPTTAEGTSIPTSTYTEGSTPLTSTPASTMPVATSEMSTLSITPVDTSTLVTTSTEPSSLPTTAEATSMLTSTLSEGSTPLTNMPVSTILVASSEASTTSTIPVDSKTFVTTASEASSSPTTAEDTSIATSTPSEGSTPLTSMPVSTTPVASSEASNLSTTPVDSKTQVTTSTEASSSPPTAEVNSMPTSTPSEGSTPLTSMSVSTMPVASSEASTLSTTPVDTSTPVTTSSEASSSSTTPEGTSIPTSTPSEGSTPLTNMPVSTRLVVSSEASTTSTTPADSNTFVTTSSEASSSSTTAEGTSMPTSTYSERGTTITSMSVSTTLVASSEASTLSTTPVDSNTPVTTSTEATSSSTTAEGTSMPTSTYTEGSTPLTSMPVNTTLVASSEASTLSTTPVDTSTPVTTSTEASSSPTTADGASMPTSTPSEGSTPLTSMPVSKTLLTSSEASTLSTTPLDTSTHITTSTEASCSPTTTEGTSMPISTPSEGSPLLTSIPVSITPVTSPEASTLSTTPVDSNSPVTTSTEVSSSPTPAEGTSMPTSTYSEGRTPLTSMPVSTTLVATSAISTLSTTPVDTSTPVTNSTEARSSPTTSEGTSMPTSTPGEGSTPLTSMPDSTTPVVSSEARTLSATPVDTSTPVTTSTEATSSPTTAEGTSIPTSTPSEGTTPLTSTPVSHTLVANSEASTLSTTPVDSNTPLTTSTEASSPPPTAEGTSMPTSTPSEGSTPLTRMPVSTTMVASSETSTLSTTPADTSTPVTTYSQASSSSTTADGTSMPTSTYSEGSTPLTSVPVSTRLVVSSEASTLSTTPVDTSIPVTTSTEASSSPTTAEGTSIPTSPPSEGTTPLASMPVSTTLVVSSEANTLSTTPVDSKTQVATSTEASSPPPTAEVTSMPTSTPGERSTPLTSMPVRHTPVASSEASTLSTSPVDTSTPVTTSAETSSSPTTAEGTSLPTSTTSEGSTLLTSIPVSTTLVTSPEASTLLTTPVDTKGPVVTSNEVSSSPTPAEGTSMPTSTYSEGRTPLTSIPVNTTLVASSAISILSTTPVDNSTPVTTSTEACSSPTTSEGTSMPNSNPSEGTTPLTSIPVSTTPVVSSEASTLSATPVDTSTPGTTSAEATSSPTTAEGISIPTSTPSEGKTPLKSIPVSNTPVANSEASTLSTTPVDSNSPVVTSTAVSSSPTPAEGTSIAISTPSEGSTALTSIPVSTTTVASSEINSLSTTPAVTSTPVTTYSQASSSPTTADGTSMQTSTYSEGSTPLTSLPVSTMLVVSSEANTLSTTPIDSKTQVTASTEASSSTTAEGSSMTISTPSEGSPLLTSIPVSTTPVASPEASTLSTTPVDSNSPVITSTEVSSSPTPAEGTSMPTSTYTEGRTPLTSITVRTTPVASSAISTLSTTPVDNSTPVTTSTEARSSPTTSEGTSMPNSTPSEGTTPLTSIPVSTTPVLSSEASTLSATPIDTSTPVTTSTEATSSPTTAEGTSIPTSTLSEGMTPLTSTPVSHTLVANSEASTLSTTPVDSNSPVVTSTAVSSSPTPAEGTSIATSTPSEGSTALTSIPVSTTTVASSETNTLSTTPAVTSTPVTTYAQVSSSPTTADGSSMPTSTPREGRPPLTSIPVSTTTVASSEINTLSTTLADTRTPVTTYSQASSSPTTADGTSMPTPAYSEGSTPLTSMPLSTTLVVSSEASTLSTTPVDTSTPATTSTEGSSSPTTAGGTSIQTSTPSERTTPLAGMPVSTTLVVSSEGNTLSTTPVDSKTQVTNSTEASSSATAEGSSMTISAPSEGSPLLTSIPLSTTPVASPEASTLSTTPVDSNSPVITSTEVSSSPIPTEGTSMQTSTYSDRRTPLTSMPVSTTVVASSAISTLSTTPVDTSTPVTNSTEARSSPTTSEGTSMPTSTPSEGSTPFTSMPVSTMPVVTSEASTLSATPVDTSTPVTTSTEATSSPTTAEGTSIPTSTLSEGTTPLTSIPVSHTLVANSEVSTLSTTPVDSNTPFTTSTEASSPPPTAEGTSMPTSTSSEGNTPLTRMPVSTTMVASFETSTLSTTPADTSTPVTTYSQAGSSPTTADDTSMPTSTYSEGSTPLTSVPVSTMPVVSSEASTHSTTPVDTSTPVTTSTEASSSPTTAEGTSIPTSPPSEGTTPLASMPVSTTPVVSSEAGTLSTTPVDTSTPMTTSTEASSSPTTAEDIVVPISTASEGSTLLTSIPVSTTPVASPEASTLSTTPVDSNSPVVTSTEISSSATSAEGTSMPTSTYSEGSTPLRSMPVSTKPLASSEASTLSTTPVDTSIPVTTSTETSSSPTTAKDTSMPISTPSEVSTSLTSILVSTMPVASSEASTLSTTPVDTRTLVTTSTGTSSSPTTAEGSSMPTSTPGERSTPLTNILVSTTLLANSEASTLSTTPVDTSTPVTTSAEASSSPTTAEGTSMRISTPSDGSTPLTSILVSTLPVASSEASTVSTTAVDTSIPVTTSTEASSSPTTAEVTSMPTSTPSETSTPLTSMPVNHTPVASSEAGTLSTTPVDTSTPVTTSTKASSSPTTAEGIVVPISTASEGSTLLTSIPVSTTPVASSEASTLSTTPVDTSIPVTTSTEGSSSPTTAEGTSMPISTPSEVSTPLTSILVSTVPVAGSEASTLSTTPVDTRTPVTTSAEASSSPTTAEGTSMPISTPGERRTPLTSMSVSTMPVASSEASTLSRTPADTSTPVTTSTEASSSPTTAEGTGIPISTPSEGSTPLTSIPVSTTPVAIPEASTLSTTPVDSNSPVVTSTEVSSSPTPAEGTSMPISTYSEGSTPLTGVPVSTTPVTSSAISTLSTTPVDTSTPVTTSTEAHSSPTTSEGTSMPTSTPSEGSTPLTYMPVSTMLVVSSEDSTLSATPVDTSTPVTTSTEATSSTTAEGTSIPTSTPSEGMTPLTSVPVSNTPVASSEASILSTTPVDSNTPLTTSTEASSSPPTAEGTSMPTSTPSEGSTPLTSMPVSTTTVASSETSTLSTTPADTSTPVTTYSQASSSPPIADGTSMPTSTYSEGSTPLTNMSFSTTPVVSSEASTLSTTPVDTSTPVTTSTEASLSPTTAEGTSIPTSSPSEGTTPLASMPVSTTPVVSSEVNTLSTTPVDSNTLVTTSTEASSSPTIAEGTSLPTSTTSEGSTPLSIMPLSTTPVASSEASTLSTTPVDTSTPVTTSSPTNSSPTTAEVTSMPTSTAGEGSTPLTNMPVSTTPVASSEASTLSTTPVDSNTFVTSSSQASSSPATLQVTTMRMSTPSEGSSSLTTMLLSSTYVTSSEASTPSTPSVDRSTPVTTSTQSNSTPTPPEVITLPMSTPSEVSTPLTIMPVSTTSVTISEAGTASTLPVDTSTPVITSTQVSSSPVTPEGTTMPIWTPSEGSTPLTTMPVSTTRVTSSEGSTLSTPSVVTSTPVTTSTEAISSSATLDSTTMSVSMPMEISTLGTTILVSTTPVTRFPESSTPSIPSVYTSMSMTTASEGSSSPTTLEGTTTMPMSTTSERSTLLTTVLISPISVMSPSEASTLSTPPGDTSTPLLTSTKAGSFSIPAEVTTIRISITSERSTPLTTLLVSTTLPTSFPGASIASTPPLDTSTTFTPSTDTASTPTIPVATTISVSVITEGSTPGTTIFIPSTPVTSSTADVFPATTGAVSTPVITSTELNTPSTSSSSTTTSFSTTKEFTTPAMTTAAPLTYVTMSTAPSTPRTTSRGCTTSASTLSATSTPHTSTSVTTRPVTPSSESSRPSTITSHTIPPTFPPAHSSTPPTTSASSTTVNPEAVTTMTTRTKPSTRTTSFPTVTTTAVPTNTTIKSNPTSTPTVPRTTTCFGDGCQNTASRCKNGGTWDGLKCQCPNLYYGELCEEVVSSIDIGPPETISAQMELTVTVTSVKFTEELKNHSSQEFQEFKQTFTEQMNIVYSGIPEYVGVNITKLRLGSVVVEHDVLLRTKYTPEYKTVLDNATEVVKEKITKVTTQQIMINDICSDMMCFNTTGTQVQNITVTQYDPEEDCRKMAKEYGDYFVVEYRDQKPYCISPCEPGFSVSKNCNLGKCQMSLSGPQCLCVTTETHWYSGETCNQGTQKSLVYGLVGAGVVLMLIILVALLMLVFRSKREVKRQKYRLSQLYKWQEEDSGPAPGTFQNIGFDICQDDDSIHLESIYSNFQPSLRHIDPETKIRIQRPQVMTTSF

SEQ ID NO: 54126 - protein, 280 aa, Homo sapiens
MTTALGSQLSSSQTVIPGSSGTISHTTVAPGSSVTGTTTGASDDQVTGSKTGTTGVALSTTVAPGSSSTEATTSTGVHRTTVVGQKTGATTRGSAKQGTRSTIEATTSFRGTGTTGSGMNTGTTGVVSGNTISPSSFNTEATSGTSERPNPGSEIGTTGIVSGTTVAPGSSNTEATTSLGNGGTTEAGSKIVTTGITTGTTIVPGSFNTKATTSTDVGVATGVGMATGITNIISGRSQPTGSKTGYTVTGSGTTALPGGFRTDSPSFPLFLICSYRGHNF

SEQ ID NO: 54127 - protein, 278 aa, Homo sapiens
PTGTQTPTPTPISTTTTVTPTPTPTGTQTPTTTPITTTTTVTPTPTPTGTQTPTTVLITTTTTMTPTPTPTSTKSTTVTPITTTTTVTATPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNG

SEQ ID NO: 54128 - protein, 1780 aa, Homo sapiens
MGLPLARLAAVCLALSLAGGSELQTEGRTRNHGHNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSWCTCTQTHTAYHVHTHGKILNQTQDGAFCYWEICGPNGTVEKHFNICSITTRPSTLTTFTTITLPTTPTTFTTTTTTTTPTSSTVLSTTPKLCCLWSDWINEDHPSSGSDDGDRETFDGVCGAPEDIECRSVKDPHLSLEQLGQKVQCDVSVGFICKNEDQFGNGPFGLCYDYKIRVNCCWPMDKCITTPSPPTTTPSPPPTSTTTLPPTTTPSPPTTTTTTPPPTTTPSPPITTTTTPPPTTTPSPPISTTTTPPPTTTPSPPTTTPSPPTTTPSPPTTTTTTPPPTTTPSPPTTTPITPPASTTTLPPTTTPSPPTTTTTTPPPTTTPITTTTTVTPTPTPTGTQTPTTTPITTTTTVTPTPTPTGTQTPTSTPITTTTTTPTPTAITTTTTVTPTPTPTGTQTPTTTPITTTTTVTPTPTPTGTQSPTPTAITTTTTVTPTPTPTGTQTPTSTPITTTTTVTPTPTPTGTQTPTPTPISTTTTVTPTPTPTGTQTPTTTPITTTTTVTPTPTPTGTQTPTTTPTPTSTKSTTVTPITTTTTVTATPTPTGTQTPTMIPISTTTTVTP

SEQ ID NO: 54129 - protein, 409 aa, Homo sapiens
DIECRSVKDPHLSLEQLGQKVQCDVSVGFICKNEDQFGNGPFGLCYDYKIRVNCCCTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDC

SEQ ID NO: 54130 - protein, 2817 aa, Homo sapiens
MGLPLARLAAVCLALSLAGGSELQTEGRTRNHGHNVCSTWGNFHYKTFDGDVFRFPGLCDYNFASDCRGSYKEFAVHLKRGPGQAEAPAGVESILLTIKDDTIYLTRHLAVLNGAVVSTPHYSPGLLIEKSDAYTKVYSRAGLTLMWNREDALMLELDTKFRNHTCGLCGDYNGLQSYSEFLSDGVLFSPLEFGNMQKINQPDVVCEDPEEEVAPASCSEHRAECERLLTAEAFADCQDLVPLEPYLRACQQDRCRCPGGDTCVCSTVAEFSRQCSHAGGRPGNWRTATLCPKTCPGNLVYLESGSPCMDTCSHLEVSSLCEEHRMDGCFCPEGTVYDDIGDSGCVPVSQCHCRLHGHLYTPGQEITNDCEQCVCNAGRWVCKDLPCPGTCALEGGSHITTFDGKTYTFHGDCYYVLAKGDHNDSYALLGELAPCGSTDKQTCLKTVVLLADKKKNVVVFKSDGSVLLNELQVNLPHVTASFSVFRPSSYHIMVSMAIGVRLQVQLAPVMQLFVTLDQASQGQVQGLCGNFNGLEGDDFKTASGLVEATGAGFANTWKAQSSCHDKLDWLDDPCSLNIESANYAEHWCSLLKKTETPFGRCHSAVDPAEYYKRCKYDTCNCQNNEDCLCAALSSYARACTAKGVMLWGWREHVCNKDVGSCPNSQVFLYNLTTCQQTCRSLSEADSHCLEGFAPVDGCGCPDHTFLDEKGRCVPLAKCSCYHRGLYLEAGDVVVRQEERCVCRDGRLHCRQIRLIGQSCTAPKIHMDCSNLTALATSKPRALSCQTLAAGYYHTECVSGCVCPDGLMDDGRGGCVVEKECPCVHNNDLYSSGAKIKVDCNTCTCKRGRWVCTQAVCHGTCSIYGSGHYITFDGKYYDFDGHCSYVAVQDYCGQNSSLGSFSIITENVPCGTTGVTCSKAIKIFMGRTELKLEDKHRVVIQRDEGHHVAYTTREVGQYLVVESSTGIIVIWDKRTTVFIKLAPSYKGTVCGLCGNFDHRSNNDFTTRDHMVVSSELDFGNSWKEAPTCPDVSTNPEPCSLNPHRRSWAEKQCSILKSSVFSICHSKVDPKPFYEACVHDSCSCDTGGDCECFCSAVASYAQECTKEGACVFWRTPDLCPIFCDYYNPPHECEWHYEPCGNRSFETCRTINGIHSNISVSYLEGCYPRCPKDRPIYEEDLKKCVTADKCGCYVEDTHYPPGASVPTEETCKSCVCTNSSQVVCRPEEGKILNQTQDGAFCYWEICGPNGTVEKHFNICSITTRPSTLTTFTTITLPTTPTTFTTTTTTTTPTSSTVLSTTPKLCCLWSDWINEDHPSSGSDDGDRETFDGVCGAPEDIECRSVKDPHLSLEQLGQKVQCDVSVGFICKNEDQFGNGPFGLCYDYKIRVNCCWPMDKCITTPSPPTTTPSPPPTSTTTLPPTTTPSPPTTTTTTPPPTTTPSPPITTTTTPPPTTTPSPPISTTTTPPPTTTPSPPTTTPSPPTTTPSPPTTTTTTPPPTTTPSPPTTTPITPPASTTTLPPTTTPSPPTTTTTTPPPTTTPITTTTTVTPTPTPTGTQTPTTTPITTTTTVTPTPTPTGTQTPTSTPITTTTTVTPTPTPTGTQTPTTTPITTTTTVTPTPTPTGTQTPTPTAITTTTTVTPTPTPTGTQTPTTTPITTTTTVTPTPTPTGTQSPTPTAITTTTTVTPTPTPTGTQTPTSTPITTTTTVTPTPTPTGTQTPTPTPISTTTTVTPTPTPTGTQTPTTTPITTTTTVTPTPTPTGTQTPTTVLITTTTTMTPTPTPTSTKSTTVTPITTTTTVTATPTPTGTQTPTMIPISTTTTVTPTPTPTTGSTGPPTHTSTAPIAELTTSNPPPESSTPQTSRSTSSPLTESTTLLSTLPPAIEMTSTAPPSTPTAPTTTSGGHTLSPPPSTTTSPPGTPTRGTTTGSSSAPTPSTVQTTTTSAWTPTPTPLSTPSIIRTTGLRPYPSSVLICCVLNDTYYAPGEEVYNGTYGDTCYFVNCSLSCTLEFYNWSCPSTPSPTPTPSKSTPTPSKPSSTPSKPTPGTKPPECPDFDPPRQENETWWLCDCFMATCKYNNTVEIVKVECEPPPMPTCSNGLQPVRVEDPDGCCWHWECDCYCTGWGDPHYVTFDGLYYSYQGNCTYVLVEEISPSVDNFGVYIDNYHCDPNDKVSCPRTLIVRHETQEVLIKTVHMMPMQVQVQVNRQAVALPYKKYGLEVYQSGINYVVDIPELGVLVSYNGLSFSVRLPYHRFGNNTKGQCGTCTNTTSDDCILPSGEIVSNCEAAADQWLVNDPSKPHCPHSSSTTKRPAVTVPGGGKTTPHKDCTPSPLCQLIKDSLFAQCHALVPPQHYYDACVFDSCFMPGSSLECASLQAYAALCAQQNICLDWRNHTHGACLVECPSHREYQACGPAEEPTCKSSSSQQNNTVLVEGCFCPEGTMNYAPGFDVCVKTCGCVGPDNVPREFGEHFEFDCKNCVCLEGGSGIICQPKRCSQKPVTHCVEDGTYLATEVNPADTCCNITVCKCNTSLCKEKPSVCPLGFEVKSKMVPGRCCPFYWCESKGVCVHGNAEYQPGSPVYSSKCQDCVCTDKVDNNTLLNVIACTHVPCNTSCSPGFELMEAPGECCKKCEQTHCIIKRPDNQHVILKPGDFKSDPKNNCTFFSCVKIHNQLISSVSNITCPNFDASICIPGSITFMPNGCCKTCTPRNETRVPCSTVPVTTEVSYAGCTKTVLMNHCSGSCGTFVMYSAKAQALDHSCSCCKEEKTSQREVVLSCPNGGSLTHTYTHIESCQCQDTVCGLPTGTSRRARRSPRHLGSG

SEQ ID NO: 54131 - protein, 876 aa, Homo sapiens
IYSTVSTSTTAITSHFTTSETAVTPTPVTPSSLSTDIPTTSLRTLTPSSVGTSTSLTTTTDFPSIPTDISTLPTRTHIISSSPSIQSTETSSLVGTTSPTMSTVRMTLRITENTPISSFSTSIVVIPETPTQTPPVLTSATGTQTSPAPTTVTFGSTDSSTSTLHTLTPSTALSTIVSTSQVPIPSTHSSTLQTTPSTPSLQTSLTSTSEFTTESFTRGSTSTNAILTSFSTIIWSSTPTIIMSSSPSSASITPVFSTTIHSVPSSPYIFSTENVGSASITGFPSLSSSATTSTSSTSSSLTTALTEITPFSYISLPSTTPCPGTITITIVPASPTDPCVEMDPSTEATSPPTTPLTVFPFTTEMVTCPTSISIQTTLTTYMDTSSMMPESESSISPNASSSTGTGTVPTNTVFTSTRLPTSETWLSNSSVIPLPLPGVSTIPLTMKPSSSLPTILRTSSKSTHPSPPTTRTSETPVATTQTPTTLTSRRTTRITSQMTTQSTLTTTAGTCDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQTLCFKPDSIKVNNNSKTELTPEAICRRAAPTGYEEFYFPLVEATRLRCVTKCTSGVDNAIDCHQGQCVLETSGPACRCYSTDTHWFSGPRCEVAVHWRALVGGLTAGAALLVLLLLALGVRAVRSGWWGGQRRGRSWDQDRKWFETWDEEVVGTFSNWGFEDDGTDKDTNFHVALENVDTTMKVHIKRPEMTSSSV

SEQ ID NO: 54132 - protein, 308 aa, Homo sapiens
CDNGGTWEQGQCACLPGFSGDRCQLQTRCQNGGQWDGLKCQCPSTFYGSSCEFAVEQVDLDVVETEVGMEVSVDQQFSPDLNDNTSQAYRDFNKTFWNQMQKIFADMQGFTFKGVEILSLRNGSIVVDYLVLLEMPFSPQLESEYEQVKTTLKEGLQNASQDANSCQDSQTLCFKPDSIKVNNNSKTELTPEAICRRAAPTGYEEFYFPLVEATRLRCVTKCTSGVDNAIDCHQGQCVLETSGPACRSWDQDRKWFETWDEEVVGTFSNWGFEDDGTDKDTNFHVALENVDTTMKVHIKRPEMTSSSV

SEQ ID NO: 54133 - protein, 1176 aa, Homo sapiens
MKGARWRRVPWVSLSCLCLCLLPHVVPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 54134 - protein, 1125 aa, Homo sapiens
MKGARWRRVPWVSLSCLCLCLLPHVVPGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 54135 - protein, 1912 aa, Homo sapiens
PGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 54136 - protein, 5412 aa, Homo sapiens
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQEYETFYGEHSLLVQQAESWIRKMTNNGGYKARWALKVTWVNAHAYPAQWTLGSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 54137 - protein, 5360 aa, Homo sapiens
MKGARWRRVPWVSLSCLCLCLLPHVVPGTTEDTLITGSKTAAPVTSTGSTTATLEGQSTAASSRTSNQDISASSQNHQTKSTETTSKAQTDTLTQMMTSTLFSSPSVHNVMETAPPDEMTTSFPSSVTNTLMMTSKTITMTTSTDSTLGNTEETSTAGTESSTPVTSAVSITAGQEGQSRTTSWRTSIQDTSASSQNHWTRSTQTTRESQTSTLTHRTTSTPSFSPSVHNVTGTVSQKTSPSGETATSSLCSVTNTSMMTSEKITVTTSTGSTLGNPGETSSVPVTGSLMPVTSAALVTFDPEGQSPATFSRTSTQDTTAFSKNHQTQSVETTRVSQINTLNTLTPVTTSTVLSSPSGFNPSGTVSQETFPSGETTTSSPSSVSNTFLVTSKVFRMPTSRDSTLGNTEETSLSVSGTISAITSKVSTIWWSDTLSTALSPSSLPPKISTAFHTQQSEGAETTGRPHERSSFSPGVSQEIFTLHETTTWPSSFSSKGHTTWSQTELPSTSTGAATRLVTGNPSTGTAGTIPRVPSKVSAIGEPGEPTTYSSHSTTLPKTTGAGAQTQWTQETGTTGEALLSSPSYSVTQMIKTATSPSSSPMLDRHTSQQITTAPSTNHSTIHSTSTSPQESPAVSQRGHTQAPQTTQESQTTRSVSPMTDTKTVTTPGSSFTASGHSPSEIVPQDAPTISAATTFAPAPTGDGHTTQAPTTALQAAPSSHDATLGPSGGTSLSKTGALTLANSVVSTPGGPEGQWTSASASTSPDTAAAMTHTHQAESTEASGQTQTSEPASSGSRTTSAGTATPSSSGASGTTPSGSEGISTSGETTRFSSNPSRDSHTTQSTTELLSASASHGAIPVSTGMASSIVPGTFHPTLSEASTAGRPTGQSSPTSPSASPQETAAISRMAQTQRTRTSRGSDTISLASQATDTFSTVPPTPPSITSTGLTSPQTETHTLSPSGSGKTFTTALISNATPLPVTYASSASTGHTTPLHVTDASSVSTGHATPLPVTSPSSVSTGHTTPLPVTDTSSESTGHVTPLPVTSFSSASTGDSTPLPVTDTSSASTGHVTPLPVTSLSSASTGDTTPLPVTDTSSASTGHATSLPVTDTSSVSTGHTTPLPVTDTSSASTGHATSLPVTDTSSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLHVTDASSASTGQATPLPVTSLSSVSTGDTTPLPVTSPSSASTGHATPLLVTDTSSASTGHATPLPVTDASSVSTDHATSLPVTIPSAASTGHTTPLPVTDTSSASTGQATSLLVTDTSSVSTGDTTPLPVTSTSSASTGHVTPLHVTSPSSASTGHATPLPVTSLSSASTGDTMPLPVTSPSSASTGDTTPLPVTDASSVSTGHTTPLPVTSPSSASTGHTTPLPVTDTSSASKGDTTPLPVTSPSSASTGHTTPLPVTDTSSASTGDTTPLPVTNASSLSTGHATPLHVTSPSSASTGHATPLPVTSTSSASTGHATPLPVTGLSSATTDDTTRLPVTDVSSASTGQATPLPVTSLSSVSTGDTTPLPVTSPSSASTGHASPLLVTDASSASTGQATPLPVTDTSSVSTAHATPLPVTGLSSASTDDTTRLPVTDVSSASTGQAIPLPVTSPSSASTGDTTPLPVTDASSASTGDTTSLPVTIPSSASSGHTTSLPVTDASSVSTGHATSLLVTDASSVSTGDTTPLPVTDTNSASTGDTTPLHVTDASSVSTGHATSLPVTSLSSASTGDTTPLPVTSPSSASSGHTTPLPVTDASSVPTGHATSLPVTDASSVSTGHATPLPVTDASSVSTGHATPLPVTDTSSVSTGQATPLPVTSLSSASTGDTTPLPVTDTSSASTGQDTPLPVTSLSSVSTGDTTPLPVTNPSSASTGHATPLLVTDASSISTGHATSLLVTDASSVSTGHATALHDTDASSLSTGDTTPLPVTSPSSTSTGDTTPLPVTETSSVSTGHATSLPVTDTSSASTGHATSLPVTDTSSASTGHATPLPVTDTSSASTGQATPLPVTSPSSASTGHAIPLLVTDTSSASTGQATPLPVTSLSSASTGDTTPLPVTDASSVSTGHATSLPVTSLSSVSTGDTTPLPVTSPSSASTGHATPLHVTDASSASTGHATPLPVTSLSSASTGDTTPLPVTSPSSASTGHATPLHVTDASSVSTGDTTPLPVTSSSSASSGHTTPLPVTDASSASTGDTTPLPVTDTSSASTGHATHLPVTGLSSASTGDTTRLPVTNVSSASTGHATPLPVTSTSSASTGDTTPLPGTDTSSVSTGHTTPLLVTDASSVSTGDTTRLPVTSPSSASTGHTTPLPVTDTPSASTGDTTPLPVTNASSLSTRHATSLHVTSPSSASTGHATSLPVTDTSAASTGHATPLPVTSTSSASTGDTTPLPVTDTYSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGDTTPLPVTDTSSASTGHATPLPVTNTSSVSTGHATPLHVTSPSSASTGHTTPLPVTDASSVSTGHATSLPVTDASSVFTGHATSLPVTIPSSASSGHTTPLPVTDASSVSTGHATSLPVTDASSVSTGHATPLPVTDASSVSTGHATPLPLTSLSSVSTGDTTPLPVTDTSSASTGQATPLPVTSLSSVSTGDTTPLPVTDTSSASTGHATSLPVTDTSSASTGHATPLPDTDTSSASTGHATLLPVTDTSSASIGHATSLPVTDTSSISTGHATPLHVTSPSSASTGHATPLPVTDTSSASTGHANPLHVTSPSSASTGHATPLPVTDTSSASTGHATPLPVTSLSSVSTGDTTPLPVTSPSSASTGHTTPLPVTDTSSASTGQATALPVTSTSSASTGDTTPLPVTDTSSASTGQATPLPVTSLSSVSTGDTTPLPVTSPSSASTGHATPLLVTDASSASTGQATPLPVTSLSSVSTGDTTPLPVTSPSSASTGHATSLPVTDTSSASTGDTTSLPVTDTSSAYTGDTTSLPVTDTSSSSTGDTTPLLVTETSSVSTGHATPLLVTDASSASTGHATPLHVTSPSSASTGDTTPVPVTDTSSVSTGHATPLPVTGLSSASTGDTTRLPVTDISSASTGQATPLPVTNTSSVSTGDTMPLPVTSPSSASTGHATPLPVTSTSSASTGHATPVPVTSTSSASTGHTTPLPVTDTSSASTGDTTPLPVTSPSSASTGHTTPLHVTIPSSASTGDTSTLPVTGASSASTGHATPLPVTDTSSVSTGHATPLPVTSLSSVSTGDTTPLPVTDASSASTGQATPLPVTSLSSVSTGDTTPLLVTDASSVSTGHATPLPVTDTSSASTGDTTRLPVTDTSSASTGQATPLPVTSLSSVSTGDTTPLLVTDASSVSTGHATPLPVTDTSSASTGDTTRLPVTDTSSASTGQATPLPVTIPSSSSSGHTTPLPVTSTSSVSTGHVTPLHVTSPSSASTGHVTPLPVTSTSSASTGHATPLLVTDASSVSTGHATPLPVTDASSASTGDTTPLPVTDTSSASTGQATPLPVTSLSSVSTGDTTPLPVTDASSASTGHATPLPVTIPSSVSTGDTMPLPVTSPSSASTGHATPLPVTGLSSASTGDTTPLPVTDTSSASTRHATPLPVTDTSSASTDDTTRLPVTDVSSASTGHATPLPVTSTSSASTGDTTPLPVTDTSSVSTGHATSLPVTSRSSASTGHATPLPVTDTSSVSTGHATPLPVTSTSSVSTGHATPLPVTSPSSASTGHATPVPVTSTSSASTGDTTPLPVTNASSLSTGHATPLHVTSPSSASRGDTSTLPVTDASSASTGHATPLPLTSLSSVSTGDTTPLPVTDTSSASTGQATPLPVTSLSSVSTGDTTPLPVTIPSSASSGHTTSLPVTDASSVSTGHGTPLPVTSTSSASTGDTTPLPVTDTSSASTGHATPLPVTDTSSASTGHATPLPVTSLSSVSTGHATPLAVSSATSASTVSSDSPLKMETPGMTTPSLKTDGGRRTATSPPPTTSQTIISTIPSTAMHTRSTAAPIPILPERGVSLFPYGAGAGDLEFVRRTVDFTSPLFKPATGFPLGSSLRDSLYFTDNGQIIFPESDYQIFSYPNPLPTGFTGRDPVALVAPFWDDADFSTGRGTTFYQSNTYQAILSTDGSRSYALFLYQSGGMQWDVAQRSGNPVLMGFSSGDGYFENSPLMSQPVWERYRPDRFLNSNSGLQGLQFYRLHREERPNYRLECLQWLKSQPRWPSWGWNQVSCPCSWQQGRRDLRFQPVSIGRWGLGSRQLCSFTSWRGGVCCSYGPWGEFREGWHVQRPWQLAQELEPQSWCCRWNDKPYLCALYQQRRPHVGCATYRPPQPAWMFGDPHITTLDGVSYTFNGLGDFLLVGAQDGNSSFLLQGRTAQTGSAQATNFIAFAAQYRSSSLGPVTVQWLLEPHDAIRVLLDNQTVTFQPDHEDGGGQETFNATGVLLSRNGSEVSASFDGWATVSVIALSNILHASASLPPEYQNRTEGLLGVWNNNPEDDFRMPNGSTIPPGSPEEMLFHFGMTWQINGTGLLGKRNDQLPSNFTPVFYSQLQKNSSWAEHLISNCDGDSSCIYDTLALRNASIGLHTREVSKNYEQANATLNQYPPSINGGRVIEAYKGQTTLIQYTSNAEDANFTLRDSCTDLELFENGTLLWTPKSLEPFTLEILARSAKIGLASALQPRTVVCHCNAESQCLYNQTSRVGNSSLEVAGCKCDGGTFGRYCEGSEDACEEPCFPSVHCVPGKGCEACPPNLTGDGRHCAALGSSFLCQNQSCPVNYCYNQGHCYISQTLGCQPMCTCPPAFTDSRCFLAGNNFSPTVNLELPLRVIQLLLSEEENASMAEVNASVAYRLGTLDMRAFLRNSQVERIDSAAPASGSPIQHWMVISEFQYRPRGPVIDFLNNQLLAAVVEAFLYHVPRRSEEPRNDVVFQPISGEDVRDVTALNVSTLKAYFRCDGYKGYDLVYSPQSGFTCVSPCSRGYCDHGGQCQHLPSGPRCSCVSFSIYTAWGEHCEHLSMKLDAFFGIFFGALGGLLLLGVGTFVVLRFWGCSGARFSYFLNSAEALP

SEQ ID NO: 54138 - protein, 620 aa, Homo sapiens
MSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNPATPQPGVSGPHAEQGPHEGGWRGHPADQGLRPGQRPPGPAALQPVWGPHSRAAATPRWRPGWALSSCGTTMTACCWLDTKYANKLWALWGLQRDARGQRAPLPQHQADTHGIREPARWTTPRSSVRTLSLNPRGTAPLALGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGVQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVEN

SEQ ID NO: 54139 - protein, 623 aa, Homo sapiens
MSVGRRKLALLWALALALACTRHTGHAQDGSSESSYKHHPALSPIARGPSGVPLRGATVFPSLRTIPVVRASNPAHNGRVCSTWGSFHYKTFDGDVFRFPGLCNYVFSEHCGAAYEDFNIQLRRSQESAAPTLSRVLMKVDGVVIQLTKGSVLVNGHPVLLPFSQSGVLIQQSSSYTKVEARLGLVLMWNHDDSLLLELDTKYANKTCGLCGDFNGMPVVSELLSHNTKLTPMEFGNLQKMDDPTEQCQDPVPEPPRNCSTGFGICEELLHGQLFSGCVALVDVGSYLEACRQDLCFCEDTDLLSCVCHTLAEYSRQCTHAGGLPQDWRGPDFCPQKCPNNMQYHECRSPCADTCSNQEHSRACEDHCVAGCFCPEGTVLDDIGQTGCVPVSKCACVYNGAAYAPGATYSTDCTNCTCSGGRWSCQEVPCPGTCSVLGGAHFSTFDGKQYTVHGDCSYVLTKPCDSSAFTVLAELRRCGLTDSETCLKSVTLSLDGVQTVVVIKASGEVFLNQIYTQLPISAANVTIFRPSTFFIIAQTSLGLQLNLQLVPTMQLFMQLAPKLRGQTCGLCGNFNSIQADDFRTLSGVVEATAAAFFNTFKTQAACPNIRNSFEDPCSLSVEN

SEQ ID NO: 54140 - protein, 5706 aa, Homo sapiens
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGSTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 54141 - protein, 5528 aa, Homo sapiens
APRMGAPSACRTLVLALAAMLVVPQAGKSPPLRPLSRNSGAGLDGGAPTSSPTRRVSFVPPVTVFPSLSRKQMLPLPAGKGVFASPKGGGPDLGVQLPPALNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGRSCTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVEVRTAPAVSTPDPAANEPAPREASVGFRQRLPPLQSYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECECVGGRGITPGAGICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHAVQVLCGLLAWGLQAGGHIRGAVQDPQQPLKDQEASGKARQGGGYRQTVAWGDKSNARAWLQKPVVWVQSGAFPTPGPASALCPW

SEQ ID NO: 54142 - protein, 5765 aa, Homo sapiens
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGRSCTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 54143 - protein, 5762 aa, Homo sapiens
MGAPSACRTLVLALAAMLVVPQAETQGPVEPSWENAGHTMDGGAPTSSPTRRVSFVPPVTVFPSLSPLNPAHNGRVCSTWGDFHYKTFDGDVFRFPGLCNYVFSEHCRAAYEDFNVQLRRGLVGSRPVVTRVVIKAQGLVLEASNGSVLINGQREELPYSRTGLLVEQSGDYIKVSIRLVLTFLWNGEDSALLELDPKYANQTCGLCGDFNGLPAFNEFYAHNARLTPLQFGNLQKLDGPTEQCPDPLPLPAGNCTDEEGICHRTLLGPAFAECHALVDSTAYLAACAQDLCRCPTCPCATFVEYSRQCAHAGGQPRNWRCPELCPRTCPLNMQHQECGSPCTDTCSNPQRAQLCEDHCVDGCFCPPGTVLDDITHSGCLPLGQCPCTHGGRTYSPGTSFNTTCSSCTCSGGLWQCQDLPCPGTCSVQGGAHISTYDEKLYDLHGDCSYVLSKKCADSSFTVLAELRKCGLTDNENCLKAVTLSLDGGDTAIRVQADGGVFLNSIYTQLPLSAANITLFTPSSFFIVVQTGLGLQLLVQLVPLMQVFVRLDPAHQGQMCGLCGNFNQNQADDFTALSGVVEATGAAFANTWKAQAACANARNSFEDPCSLSVENENYARHWCSRLTDPNSAFSRCHSIINPKPFHSNCMFDTCNCERSEDCLCAALSSYVHACAAKGVQLSDWRDGVCTKYMQNCPKSQRYAYVVDACQPTCRGLSEADVTCSVSFVPVDGCTCPAGTFLNDAGACVPAQECPCYAHGTVLAPGEVVHDEGAVCSCTGGKLSCLGASLQKSTGCAAPMVYLDCSNSSAGTPGAECLRSCHTLDVGCFSTHCVSGCVCPPGLVSDGSGGCIAEEDCPCVHNEATYKPGETIRVDCNTCTCRNRRWECSHRLCLGTCVAYGDGHFITFDGDRYSFEGSCEYILAQDYCGDNTTHGTFRIVTENIPCGTTGTTCSKAIKLFVESYELILQEGTFKAVARGPGGDPPYKIRYMGIFLVIETHGMAVSWDRKTSVFIRLHQDYKGRVCGLCGNFDDNAINDFATRSRSVVGDALEFGNSWKLSPSCPDALAPKDPCTANPFRKSWAQKQCSILHGPTFAACRSQVDSTKYYEACVNDACACDSGGDCECFCTAVAAYAQACHDAGLCVSWRTPDTCPLFCDFYNPHGGCEWHYQPCGAPCLKTCRNPSGHCLVDLPGLEGCYPKCPPSQPFFNEDQMKCVAQCGCYDKDGNYYDVGARVPTAENCQSCNCTPSGIQCAHSLEACTCTYEDRTYSYQDVIYNTTDGLGACLIAICGSNGTIIRKAVACPGTPATTPFTFTTAWVPHSTTSPALPVSTVCVREVCRWSSWYNGHRPEPGLGGGDFETFENLRQRGYQVCPVLADIECRAAQLPDMPLEELGQQVDCDRMRGLMCANSQQSPPLCHDYELRVLCCEYVPCGPSPAPGTSPQPSLSASTEPAVPTPTQTTATEKTTLWVTPSIRSTAALTSQTGSSSGPVTVTPSAPGTTTCQPRCQWTEWFDEDYPKSEQLGGDVESYDKIRAAGGHLCQQPKDIECQAESFPNWTLAQVGQKVHCDVHFGLVCRNWEQEGVFKMCYNYRIRVLCCSDDHCRGRATTPPPTTELETATTTTTQALFSTPQPTSSPGLTRAPPASTTAVPTLSEGLTSPRYTSTLGTATTGGPTTPAGSTEPTVPGVATSTLPTRSALPGTTGSLGTWRPSQPPTLAPTTMATSRARPTGTASTASKEPLTTSLAPTLTSELSTSQAETSTPRTETTMSPLTNTTTSQGTTRCQPKCEWTEWFDVDFPTSGVAGGDMETFENIRAAGGKMCWAPKSIECRAENYPEVSIDQVGQVLTCSLETGLTCKNEDQTGRFNMCFNYNVRVLCCDDYSHCPSTPATSSTATPSSTPGTTWILTKPTTTATTTASTGSTATPTSTLRTAPPPKVLTTTATTPTVTSSKATPSSSPGTATALPALRSTATTPTATSVTPIPSSSLGTTWTRLSQTTTPTATMSTATPSSTPETAHTSTVLTATATTTGATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSNTVTPSSALGTTHTPPVPNTMATTHGRSLPPSSPHTVRTAWTSATSGILGTTHITEPSTVTSHTLAATTGTTQHSTPALSSPHPSSRTTESPPSPGTTTPGHTTATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTAMPSSTPGTTWILTELTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETVHTSTVLTTTATTTGATGSVATPSSTPGTAHTTKVLTTTTTGFTATPSSSPGTARTLPVWISTTTTPTTRGSTVTPSSIPGTTHTPTVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTRATSRTTATATPSKTRTSTLLPSSPTSAPITTVVTMGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTEQTTAATTTATTGSTAIPSSTPGTAPPPKVLTSTATTPTATSSKATSSSSPRTATTLPVLTSTATKSTATSFTPIPSFTLGTTGTLPEQTTTPMATMSTIHPSSTPETTHTSTVLTTKATTTRATSSMSTPSSTPGTTWILTELTTAATTTAATGPTATPSSTPGTTWILTEPSTTATVTVPTGSTATASSTRATAGTLKVLTSTATTPTVISSRATPSSSPGTATALPALRSTATTPTATSVTAIPSSSLGTAWTRLSQTTTPTATMSTATPSSTPETVHTSTVLTTTTTTTRATGSVATPSSTPGTAHTTKVPTTTTTGFTATPSSSPGTALTPPVWISTTTTPTTRGSTVTPSSIPGTTHTATVLTTTTTTVATGSMATPSSSTQTSGTPPSLTTTATTITATGSTTNPSSTPGTTPIPPVLTTTATTPAATSSTVTPSSALGTTHTPPVPNTTATTHGRSLPPSSPHTVRTAWTSATSGILGTTHITEPSTVTSHTPAATTSTTQHSTPALSSPHPSSRTTESPPSPGTTTPGHTRGTSRTTATATPSKTRTSTLLPSSPTSAPITTVVTTGCEPQCAWSEWLDYSYPMPGPSGGDFDTYSNIRAAGGAVCEQPLGLECRAQAQPGVPLRELGQVVECSLDFGLVCRNREQVGKFKMCFNYEIRVFCCNYGHCPSTPATSSTATPSSTPGTTWILTKLTTTATTTESTGSTATPSSTPGTTWILTEPSTTATVTVPTGSTATASSTQATAGTPHVSTTATTPTVTSSKATPFSSPGTATALPALRSTATTPTATSFTAIPSSSLGTTWTRLSQTTTPTATMSTATPSSTPETAHTSTVLTTTATTTRATGSVATPSSTPGTAHTTKVPTTTTTGFTVTPSSSPGTARTPPVWISTTTTPTTSGSTVTPSSVPGTTHTPTVLTTTTTTVATGSMATPSSSTQTSGTPPSLITTATTITATGSTTNPSSTPGTTPIPPVLTTTATTPAATSSTVTPSSALGTTHTPPVPNTTATTHGRSLSPSSPHTVRTAWTSATSGTLGTTHITEPSTGTSHTPAATTGTTQHSTPALSSPHPSSRTTESPPSPGTTTPGHTTATSRTTATATPSKTRTSTLLPSSPTSAPITTVVTTGCEPQCAWSEWLDYSYPMPGPSGGDFDTYSNIRAAGGAVCEQPLGLECRAQAQPGVPLGELGQVVECSLDFGLVCRNREQVGKFKMCFNYEIRVFCCNYGHCPSTPATSSTAMPSSTPGTTWILTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTPTATSFTAIPSSSLGTTWTRLSQTTTPTATMSTATPSSTPETVHTSTVLTATATTTGATGSVATPSSTPGTAHTTKVPTTTTTGFTATPSSSPGTALTPPVWISTTTTPTTTTPTTSGSTVTPSSIPGTTHTARVLTTTTTTVATGSMATPSSSTQTSGTPPSLTTTATTITATGSTTNPSSTPGTTPITPVLTSTATTPAATSSKATSSSSPRTATTLPVLTSTATKSTATSFTPIPSSTLWTTWTVPAQTTTPMSTMSTIHTSSTPETTHTSTVLTTTATMTRATNSTATPSSTLGTTRILTELTTTATTTAATGSTATLSSTPGTTWILTEPSTIATVMVPTGSTATASSTLGTAHTPKVVTTMATMPTATASTVPSSSTVGTTRTPAVLPSSLPTFSVSTVSSSVLTTLRPTGFPSSHFSTPCFCRAFGQFFSPGEVIYNKTDRAGCHFYAVCNQHCDIDRFQGACPTSPPPVSSAPLSSPSPAPGCDNAIPLRQVNETWTLENCTVARCVGDNRVVLLDPKPVANVTCVNKHLPIKVSDPSQPCDFHYECECICSMWGGSHYSTFDGTSYTFRGNCTYVLMREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMAPPHTRGFPAQEATAV

SEQ ID NO: 54144 - protein, 536 aa, Homo sapiens
VFCCNYGHCPPRPPALRPCPPPLRGRPGSTELTTTATTTASTGSTATPSSTPGTAPPPKVLTSPATTPTATSSKATSSSSPRTATTLPVLTSTATKSTATSVTPIPSSTLGTTGTLPEQTTTPVATMSTIHPSSTPETTHTSTVLTTKATTTRATSSTSTPSSTPGTTWILTELTTAATTTAATGPTATPSSTPGTTWILTELTTTATTTASTGSTATPSSTPGTTWILTEPSTTATVTVPTGSTATASSTQATAGTPHVSTTATTPTVTSSKATPSSSPGTATALPALRSTATTHSYQLYSHPLLLPTTWTRLSQTTTPTATMSTATPSSTPETVHTSTVLTATATTTGPALWPPPPPPQEQLTLPKCRLPQPRHSHPLLQPRDGTHASSVDQHNHHTHNHHTHNQWLHGDPLLHPGDHPHRQSADHHHHNCTGSMATPSSSTQTSGTPPSLTTTATTITATGSTTNPSSTPGTTPITPVLTSTATTPAATSSKATSSSSPRTATTLPVLTSTATKSTATSFTPIPSPCGPRGPS

SEQ ID NO: 54145 - protein, 186 aa, Homo sapiens
SSTPGTTWILTEPSTTATVTVPTGSTATASSTQATAGTPHVSTTATTPTVTSSKATPFSSPGTATALPALRSTATTPTATSFTAIPSSWAPPGPAYHRPPHPRPPCPQPHPPPLQRLSTPPQCLPPRPPRGHRLCGHPLLHPRNSSHYQSADYHNHFTATPSSSPGTARTLPVWISTTTTPTTRGS

SEQ ID NO: 54146 - protein, 319 aa, Homo sapiens
TKATTTRATSSMSTPSSTPGTTWILTELTTAATTTAATPHGHPVLHPRDHLDPHRAQHYTVTVPTGSTATASSTRATAGTLKVLTSHHTHSHQLQSHSLLQSRDCNRPSSTEKHSHHTHSYQRYSHPLFLPTAWTRLSQTTTPTATMSTATPSSTPETVHTSTVLTTTTTTTRATLWPPPPPPQEQLTLPKCRLPQPRHSHPLLQPRDGTHASSVDQHNHHTHNQRLHGDPLLHPTTHTATVLTTTTTTPLVLWQHPPLAHRPVVPPSLTTTATTITATGSTTNPSSTPGTTPIPPVLTTTAHTCSHQQHSDSLLCPRD

SEQ ID NO: 54147 - protein, 668 aa, Homo sapiens
MREIHARFGNLSLYLDNHYCTASATAAAARCPRALSIHYKSMDIVLTVTMVHGKEEGLILFDQIPVSSGFSKNGVLVSVLGTTTMRVDIPALGVSVTFNGQVFQARLPYSLFHNNTEGQCGTCTNNQRDDCLQRDGTTAASCKDMAKTWLVPDSRKDGCWAPTGTPPTASPAAPVSSTPTPTPCPPQPLCDLMLSQVFAECHNLVPPGPFFNACISDHCRGRLEVPCQSLEAYAELCRARGVCSDWRGATGGLCDLTCPPTKVYKPCGPIQPATCNSRNQSPQLEGMAEGCFCPEDQILFNAHMGICVQACPCVGPDGFPKFPGERWVSNCQSCVCDEGSVSVQCKPLPCDAQGQPPPCNRPGFVTVTRPRAENPCCPETVCVCNTTTCPQSLPVCPPGQESICTQEEGDCCPTFRCRPQLCSYNGTFYGVGATFPGALPCHMCTCLSGDTQDPTVQCQEDACNNTTCPQGFEYKRVAGQCCGECVQTACLTPDGQPVQLNETWVNSHVDNCTVYLCEAEGGVHLLTPQPASCPDVSSCRGSLRKTGCCYSCEEDSCQVRINTTILWHQGCETEVNITFCEGSCPGASKYSAEAQAMQHQCTCCQERRVHEETVPLHCPNGSAILHTYTHVDECGCTPFCVPAPMSPPACVWHPALRAPAAHLGLAPP

SEQ ID NO: 54148 - protein, 2439 aa, Homo sapiens
MVQRWLLLSCCGALLSAGLANTSYTSPGLQRLKDSPQTAPDKGQCSTWGAGHFSTFDHHVYDFSGTCNYIFAATCKDAFPTFSVQLRRGPDGSISRIIVELGASVVTVSEAIISVKDIGVISLPYTSNGLQITPFGQSVRLVAKQLELELEVVWGPDSHLMVLVERKYMGQMCGLCGNFDGKVTNEFVSEEGKFLEPHKFAALQKLDDPGEICTFQDIPSTHVRQAQHARICTQLLTLVAPECSVSKEPFVLSCQADVAAAPQPGPQNSSCATLSEYSRQCSMVGQPVRRWRSPGLCSVGQCPANQVYQECGSACVKTCSNPQHSCSSSCTFGCFCPEGTVLNDLSNNHTCVPVTQCPCVLHGAMYAPGEVTIAACQTCRCTLGRWVCTERPCPGHCSLEGGSFVTTFDARPYRFHGTCTYILLQSPQLPEDGALMAVYDKSGVSHSETSLVAVVYLSRQDKIVISQDEVVTNNGEAKWLPYKTRNITVFRQTSTHLQMATSFGLELVVQLRPIFQAYVTVGPQFRGQTRGLCGNFNGDTTDDFTTSMGIAEGTASLFVDSWRAGNCPAALERETDPCSMSQLNKVCAETHCSMLLRTGTVFERCHATVNPAPFYKRCVYQACNYEETFPHICAALGDYVHACSLRGVLLWGWRSSVDNCTIPCTGNTTFSYNSQACERTCLSLSDRATECHHSAVPVDGCNCPDGTYLNQKGECVRKAQCPCILEGYKFILAEQSTVINGITCHCINGRLSCPQRPQMFLASCQAPKTFKSCSQSSENKFGAACAPTCQMLATGVACVPTKCEPGCVCAEGLYENADGQCVPPEECPCEFSGVSYPGGAELHTDCRTCSCSRGRWACQQGTHCPSTCTLYGEGHVITFDGQRFVFDGNCEYILATDVCGVNDSQPTFKILTENVICGNSGVTCSRAIKIFLGGLSVVLADRNYTVTGEEPHVQLGVTPGALSLVVDISIPGRYNLTLIWNRHMTILIRIARASQDPLCGLCGNFNGNMKDDFETRSRYVASSELELVNSWKESPLCGDVSFVTDPCSLNAFRRSWAERKCSVINSQTFATCHSKVYHLPYYEACVRDACGCDSGGDCECLCDAVAAYAQACLDKGVCVDWRTPAFCPIYCGFYNTHTQDGHGEYQYTQEANCTWHYQPCLCPSQPQSVPGSNIEGCYNCSQDEYFDHEEGVCVPCMPPTTPQPPTTPQLPTTGSRPTQVWPMTGTSTTIGLLSSTGPSPSSNHTPASPTQTPLLPATLTSSKPTASSGEPPRPTTAVTPQATSGLPPTATLRSTATKPTVTQATTRATASTASPATTSTAQSTTRTTMTLPTPATSGTSPTLPKSTNQELPGTTATQTTGPRPTPASTTGPTTPQPGQPTRPTATETTQTRTTTEYTTPQTPHTTHSPPTAGSPVPSTGPVTATSFHATTTYPTPSHPETTLPTHVPPFSTSLVTPSTHTVITPTHAQMATSASNHSAPTGTIPPPTTLKATGSTHTAPPITPTTSGTSQAHSSFSTNKTPTSLHSHTSSTHHPEVTPTSTTTITPNPTSTRTRTPVAHTNSATSSRPPPPFTTHSPPTGSSPFSSTGPMTATSFKTTTTYPTPSHPQTTLPTHVPPFSTSLVTPSTHTVITPTHAQMATSASIHSMPTGTIPPPTTLKATGSTHTAPTMTLTTSGTSQALSSLNTAKTSTSLHSHTSSTHHAEATSTSTTNITPNPTSTGTPPMTVTTSGTSQSRSSFSTAKTSTSLHSHTSSTHHPEVTSTSTTSITPNHTSTGTRTPVAHTTSATSSRLPTPFTTHSPPTGTTPISSTGPVTATSFQTTTTYPTPSHPHTTLPTHVPSFSTSLVTPSTHTVIIPTHTQMATSASIHSMPTGTIPPPTTIKATGSTHTAPPMTPTTSGTSQSPSSFSTAKTSTSLPYHTSSTHHPEVTPTSTTNITPKHTSTGTRTPVAHTTSASSSRLPTPFTTHSPPTGSSPFSSTGPMTATSFQTTTTYPTPSHPQTTLPTHVPPFSTSLVTPSTHTVIITTHTQMATSASIHSTPTGTVPPPTTLKATGSTHTAPPMTVTTSGTSQTHSSFSTATASSSFISSSSWLPQNSSSRPPSSPITTQLPHLSSATTPVSTTNQLSSSFSPSPSAPSTVSSYVPSSHSSPQTSSPSVGTSSSFVSAPVHSTTLSSGSHSSLSTHPTTASVSASPLFPSSPAASTTIRATLPHTISSPFTLSALLPISTVTVSPTPSSHLASSTIAFPSTPRTTASTHTAPAFSSQSTTSRSTSLTTRVPTSGFVSLTSGVTGIPTSPVTNLTTRHPGPTLSPTTRFLTSSLTAHGSTPASAPVSSLGTPTPTSPGVCSVREQQEEITFKGCMANVTVTRCEGACISAASFNIITQQVDARCSCCRPLHSYEQQLELPCPDPSTPGRRLVLTLQVFSHCVCSSVACGD

SEQ ID NO: 54149 - protein, 377 aa, Homo sapiens
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNATTISSRENVNTSSSVATLAPVNSPAPQDTTAAPPTPSATTPAPPSSSAPPETTAAPPTPSATTQAPPSSSAPPETTAAPPTPPATTPAPPSSSAPPETTAAPPTPSATTPAPLSSSAPPETTAVPPTPSATTLDPSSASAPPETTAAPPTPSATTPAPPSSPAPQETTAAPITTPNSSPTTLAPDTSETSAAPTHQTTTSVTTQTTTTKQPTSAPGQNKISRFLLYMKNLLNRIIDDMVEQ

SEQ ID NO: 54150 - protein, 377 aa, Homo sapiens; identical to SEQ ID NO: 54149

SEQ ID NO: 54151 - protein, 377 aa, Homo sapiens; identical to SEQ ID NO: 54149

SEQ ID NO: 54152 - protein, 136 aa, Homo sapiens
MKTLPLFVCICALSACFSFSEGRERDHELRHRRHHHQSPKSHFELPHYPGLLAHQKPFIRKSYKCLHKRCRPKLPPSPNNPPKFPNPHQPPKHPDKNSSVVNPTLVATTQIPSVTFPSASTKITTLPNVTFLPQNA

SEQ ID NO: 54153 - protein, 580 aa, Homo sapiens
MTAPAGPRGSETERLLTPNPGYGTQAGPSPAPPTPPEEEDLRRRLKYFFMSPCDKFRAKGRKPCKLMLQVVKILVVTVQLILFGLSNQLAVTFREENTIAFRHLFLLGYSDGADDTFAAYTREQLYQAIFHAVDQYLALPDVSLGRYAYVRGGGDPWTNGSGLALCQRYYHRGHVDPANDTFDIDPMVVTDCIQVDPPERPPPPPSDDLTLLESSSSYKNLTLKFHKLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 54154 - protein, 545 aa, Homo sapiens
MTPSQPTRGSSCTRPSSMLWTSTWRCLTCHWAGMRMSVVGVTLGPMAQGLLSASGTTTEATWTRPTTHLTLIRWWLLTASRWIPPSGPLRPPATISPSWKAAPVTRTSRSNSTSTACSLEGGPGWGRQHTRHSHPSNYFPKVGTGPPRPRWCLLGEHFPCQLQSQHVAGDAGTWGRKGPEDAPDPHPSLLPRLVNVTIHFRLKTINLQSLINNEIPDCYTFSVLITFDNKAHSGRIPISLETQAHIQECKHPSVFQHGDNSFRLLFDVVVILTCSLSFLLCARSLLRGFLLQNEFVGFMWRQRGRVISLWERLEFVNGWYILLVTSDVLTISGTIMKIGIEAKNLASYDVCSILLGTSTLLVWVGVIRYLTFFHNYNILIATLRVALPSVMRFCCCVAVIYLGYCFCGWIVLGPYHVKFRSLSMVSECLFSLINGDDMFVTFAAMQAQQGRSSLVWLFSQLYLYSFISLFIYMVLSLFIALITGAYDTIKHPGGAGAEESELQAYIAQCQDSPTSGKFRRGSGSACSLLCCCGRDPSEEHSLLVN

SEQ ID NO: 54155 - protein, 566 aa, Homo sapiens
MARQPYRFPQARIPERGSGVFRLTVRNAMAHRDSEMKEECLREDLKFYFMSPCEKYRARRQIPWKLGLQILKIVMVTTQLVRFGLSNQLVVAFKEDNTVAFKHLFLKGYSGTDEDDYSCSVYTQEDAYESIFFAINQYHQLKDITLGTLGYGENEDNRIGLKVCKQHYKKGTMFPSNETLNIDNDVELDCVQLDLQDLSKKPPDWKNSSFFRLEFYRLLQVEISFHLKGIDLQTIHSRELPDCYVFQNTIIFDNKAHSGKIKIYFDSDAKIEECKDLNIFGSTQKNAQYVLVFDAFVIVICLASLILCTRSIVLALRLRKRFLNFFLEKYKRPVCDTDQWEFINGWYVLVIISDLMTIIGSILKMEIKAKNLTNYDLCSIFLGTSTLLVWVGVIRYLGYFQAYNVLILTMQASLPKVLRFCACAGMIYLGYTFCGWIVLGPYHDKFENLNTVAECLFSLVNGDDMFATFAQIQQKSILVWLFSRLYLYSFISLFIYMILSLFIALITDSYDTIKKFQQNGFPETDLQEFLKECSSKEEYQKESSAFLSCICCRRRKRSDDHLIPIS

SEQ ID NO: 54156 - protein, 553 aa, Homo sapiens
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 54157 - protein, 497 aa, Homo sapiens
MADPEVVVSSCSSHEEENRCNFNQQTSPSEELLLEDQMRRKLKFFFMNPCEKFWARGRKPWKLAIQILKIAMVTIQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQEFVNFFLLHYKKEVSVSDQMEFVNGWYIMIIISDILTIIGSILKMEIQAKSLTSYDVCSILLGTSTMLVWLGVIRYLGFFAKYNLLILTLQAALPNVIRFCCCAAMIYLGYCFCGWIVLGPYHDKFRSLNMVSECLFSLINGDDMFATFAKMQQKSYLVWLFSRIYLYSFISLFIYMILSLFIALITDTYETIKQYQQDGFPETELRTFISECKDLPNSGKYRLEDDPPVSLFCCCKK

SEQ ID NO: 54158 - protein, 321 aa, Homo sapiens
MADPEVVVSSCSSHEEENRCNFNQQTSPSEELLLEDQMRRKLKFFFMNPCEKFWARGRKPWKLAIQILKIAMVTIQLVLFGLSNQMVVAFKEENTIAFKHLFLKGYMDRMDDTYAVYTQSDVYDQLIFAVNQYLQLYNVSVGNHAYENKGTKQSAMAICQHFYKRGNIYPGNDTFDIDPEIETECFFVEPDEPFHIGTPAENKLNLTLDFHRLLTVELQFKLKAINLQTVRHQELPDCYDFTLTITFDNKAHSGRIKISLDNDISIRECKDWHVSGSIQKNTHYMMIFDAFVILTCLVSLILCIRSVIRGLQLQQVGNVAF

SEQ ID NO: 54159 - protein, 497 aa, Homo sapiens; identical to SEQ ID NO: 54157

SEQ ID NO: 54160 - protein, 553 aa, Homo sapiens; identical to SEQ ID NO: 54156

SEQ ID NO: 54161 - protein, 813 aa, Homo sapiens
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 54162 - protein, 824 aa, Homo sapiens
MSLLGDPLQALPPSAAPTGPLLAPPAGATLNRLREPLLRRLSELLDQAPEGRGWRRLAELAGSRGRLRLSCLDLEQCSLKVLEPEGSPSLCLLKLMGEKGCTVTELSDFLQAMEHTEVLQLLSPPGIKITVNPESKAVLAGQFVKLCCRATGHPFVQYQWFKMNKEIPNGNTSELIFNAVHVKDAGFYVCRVNNNFTFEFSQWSQLDVCDIPESFQRSVDGVSESKLQICVEPTSQKLMPGSTLVLQCVAVGSPIPHYQWFKNELPLTHETKKLYMVPYVDLEHQGTYWCHVYNDRDSQDSKKVEIIIGRTDEAVECTEDELNNLGHPDNKEQTTDQPLAKDKVALLIGNMNYREHPKLKAPLVDVYELTNLLRQLDFKVVSLLDLTEYEMRNAVDEFLLLLDKGVYGLLYYAGHGYENFGNSFMVPVDAPNPYRSENCLCVQNILKLMQEKETGLNVFLLDMCRKRNDYDDTIPILDALKVTANIVFGYATCQGAEAFEIQHSGLANGIFMKFLKDRLLEDKKITVLLDEVAEDMGKCHLTKGKQALEIRSSLSEKRALTDPIQGTEYSAESLVRNLQWAKAHELPESMCLKFDCGVQIQLGFAAEFSNVMIIYTSIVYKPPEIIMCDAYVTDFPLDLDIDPKDANKGTPEETGSYLVSKDLPKHCLYTRLSSLQKLKEHLVFTVCLSYQYSGLEDTVEDKQEVNVGKPLIAKLDMHRGLGRKTCFQTCLMSNGPYQSSAATSGGAGHYHSLQDPFHGVYHSHPGNPSNVTPADSCHCSRTPDAFISSFAHHASCHFSRSNVPVETTDEIPFSFSDRLRISEK

SEQ ID NO: 54163 - protein, 146 aa, Homo sapiens
MTMRSLLRTPFLCGLLWAFCAPGARAEEPAASFSQPGSMGLDKNTVHDQEHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 54164 - protein, 146 aa, Homo sapiens; identical to SEQ ID NO: 54163

SEQ ID NO: 54165 - protein, 94 aa, Homo sapiens
MEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 54166 - protein, 146 aa, Homo sapiens; identical to SEQ ID NO: 54163

SEQ ID NO: 54167 - protein, 146 aa, Homo sapiens; identical to SEQ ID NO: 54163

SEQ ID NO: 54168 - protein, 94 aa, Homo sapiens; identical to SEQ ID NO: 54165

SEQ ID NO: 54169 - protein, 94 aa, Homo sapiens; identical to SEQ ID NO: 54165

SEQ ID NO: 54170 - protein, 146 aa, Homo sapiens; identical to SEQ ID NO: 54163

SEQ ID NO: 54171 - protein, 146 aa, Homo sapiens; identical to SEQ ID NO: 54163

SEQ ID NO: 54172 - protein, 61 aa, Homo sapiens
MTMRSLLRTPFLCGLLWAFCAPGARAEEPAASFSQPGSMGLDKNTVHDQEHIMEHLEGVIN

SEQ ID NO: 54173 - protein, 127 aa, Homo sapiens
MLSVCSCRTSSGMRSQWPSARQRSSSLSTFRHIMEHLEGVINKPEAEMSPQELQLHYFKMHDYDGNNLLDGLELSTAITHVHKEEGSEQAPLMSEDELINIIDGVLRDDDKNNDGYIDYAEFAKSLQ

SEQ ID NO: 54174 - protein, 1140 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGVHCDSVCAEGRWGPNCSLPCYCKNGASCSPDDGICECAPGFRGTTCQRICSPGFYGHRCSQTCPQCVHSSGPCHHITGLCDCLPGFTGALCNEVCPSGRFGKNCAGICTCTNNGTCNPIDRSCQCYPGWIGSDCSQPCPPAHWGPNCIHTCNCHNGAFCSAYDGECKCTPGWTGLYCTQRCPLGFYGKDCALICQCQNGADCDHISGQCTCRTGFMGRHCEQKCPSGTYGYGCRQICDCLNNSTCDHITGTCYCSPGWKGARCDQAGVIIVGNLNSLSRTSTALPADSYQIGAIAGIIILVLVVLFLLALFIIYRHKQKGKESSMPAVTYTPAMRVVNADYTISGTLPHSNGGNANSHYFTNPSYHTLTQCATSPHVNNRDRMTVTKSKNNQLFVNLKNVNPGKRGPVGDCTGTLPADWKHGGYLNELGAFGLDRSYMGKSLKDLGKNSEYNSSNCSLSSSENPYATIKDPPVLIPKSSECGYVEMKSPARRDSPYAEINNSTSANRNVYEVEPTVSVVQGVFSNNGRLSQDPYDLPKNSHIPCHYDLLPVRDSSSSPKQEDSGGSSSNSSSSSE

SEQ ID NO: 54175 - protein, 567 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSCPSGWMGTVCGQPCPEGRFGKNCSQECQCHNGGTCDAATGQCHCSPGYTGERCQDECPVGTYGVLCAETCQCVNGGKCYHVSGACLCEAGFAGERCEARLCPEGLYGIKCDKRCPCHLENTHSCHPMSGECACKPGWSGLYCNETCSPGFYGEACQQICSCQNGADCDSVTGKCTCAPGFKGIDCSTPCPLGTYGINCSSRCGCKNDAVCSPVDGSCTCKAGWHGVDCSIRCPSGTWGFGCNLTCQCLNGGACNTLDGTCTCAPGWRGEKCELPCQDGTYGLNCAERCDCSHADGCHPTTGHCRCLPGWSGLF

SEQ ID NO: 54176 - protein, 1140 aa, Homo sapiens; identical to SEQ ID NO: 54174

SEQ ID NO: 54177 - protein, 969 aa, Homo sapiens
MHTPSIRSITHDAQTSSTGSSAPGTALCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 54178 - protein, 875 aa, Homo sapiens
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRKPHLLASQPLRIPCCGLLATVGIVQTSREGGMQAAPGLVVPDSCPTRTEELCRGSSRPDWIQGIDKPKVLEGQGCKAAQQHFLGRTVGAYASVRMAPAVTTSVASAPAAQASPGNTVSRDVPQEPLAMGVSSYVSA

SEQ ID NO: 54179 - protein, 137 aa, Homo sapiens
MMEELNPYTKISPALGAERHSVGAVTGIMLLLFLIVVLLGLFAWHRRRQKEKGRDLAPRVSYTPAMRMTSTDYSLSASTTPWWPVMEHLARPFSQRPRTQLSNKSLDRDTAGWTPYSYVNVLDQCPGGQVPARGLLH

SEQ ID NO: 54180 - protein, 969 aa, Homo sapiens; identical to SEQ ID NO: 54177

SEQ ID NO: 54181 - protein, 1044 aa, Homo sapiens
MVLSLTGLIAFSFLQATLALNPEDPNVCSHWESYAVTVQESYAHPFDQIYYTRCTDILNWFKCTRHRISYKTAYRRGLRTMYRRRSQCCPGYYESGDFCIPLCTEECVHGRCVSPDTCHCEPGWGGPDCSSGCDSDHWGPHCSNRCQCQNGALCNPITGACVCAAGFRGWRCEELCAPGTHGKGCQLPCQCRHGASCDPRAGECLCAPGYTGVYCEELCPPGSHGAHCELRCPCQNGGTCHHITGECACPPGWTGAVCAQPCPPGTFGQNCSQDCPCHHGGQCDHVTGQCHCTAGYMGDRCQEECPFGSFGFQCSQHCDCHNGGQCSPTTGACECEPGYKGPRCQERLCPEGLHGPGCTLPCPCDADNTISCHPVTGACTCQPGWSGHHCNESCPVGYYGDGCQLPCTCQNGADCHSITGGCTCAPGFMGEVCAVSCAAGTYGPNCSSICSCNNGGTCSPVDGSCTCKEGWQGLDCTLPCPSGTWGLNCNESCTCANGAACSPIDGSCSCTPGWLGDTCELPCPDGTFGLNCSEHCDCSHADGCDPVTGHCCCLAGWTGIRCDSTCPPGRWGPNCSVSCSCENGGSCSPEDGSCECAPGFRGPLCQRICPPGFYGHGCAQPCPLCVHSSRPCHHISGICECLPGFSGALCNQVCAGGYFGQDCAQLCSCANNGTCSPIDGSCQCFPGWIGKDCSQACPPGFWGPACFHACSCHNGASCSAEDGACHCTPGWTGLFCTQRCPAAFFGKDCGRVCQCQNGASCDHISGKCTCRTGFTGQHCEQRCAPGTFGYGCQQLCECMNNSTCDHVTGTCYCSPGFKGIRCDQAALMMEELNPYTKISPALGAERHSVGAVTGIMLLLFLIVVLLGLFAWHRRRQKEKGRDLAPRVSYTPAMRMTSTDYSLSGACGMDRRQNTYIMDKGFKDYMKESVCSSSTCSLNSSENPYATIKDPPILTCKLPESSYVEMKSPVHMGSPYTDVPSLSTSNKNIYEVEPTVSVVQEGCGHNSSYIQNAYDLPRNSHIPGHYDLLPVRQSPANGPSQDKQS

SEQ ID NO: 54182 - protein, 1044 aa, Homo sapiens; identical to SEQ ID NO: 54181

SEQ ID NO: 54183 - protein, 1229 aa, Homo sapiens
MGASRDRGLAALWCLGLLGGLARVAGTHYRYLWRGCYPCHLGQAGYPVSAGDQRPDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAEKCLPRDVRAGCRHSGGCLNGGLCDPHTGRCLCPAGWTGDKCQSPCLRGWFGEACAQRCSCPPGAACHHVTGACRCPPGFTGSGCEQGCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHRRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 54184 - protein, 1541 aa, Homo sapiens
MSFLEEARAAGRAVVLALVLLLLPAVPVGASVPPRPLLPLQPGMPHVCAEQELTLVGRRQPCVQALSHTVPVWKAGCGWQAWCVGHERRTVYYMGYRQVYTTEARTVLRCCRGWMQQPDEEGCLSAECSASLCFHGGRCVPGSAQPCHCPPGFQGPRCQYDVDECRTHNGGCQHRCVNTPGSYLCECKPGFRLHTDSRTCLAINSCALGNGGCQHHCVQLTITRHRCQCRPGFQLQEDGRHCVRRSPCANRNGSCMHRCQVVRGLARCECHVGYQLAADGKACEDVDECAAGLAQCAHGCLNTQGSFKCVCHAGYELGADGRQCYRIEMEIVNSCEANNGGCSHGCSHTSAGPLCTCPRGYELDTDQRTCIDVDDCADSPCCQQVCTNNPGGYECGCYAGYRLSADGCGCEDVDECASSRGGCEHHCTNLAGSFQCSCEAGYRLHEDRRGCSPLEEPMVDLDGELPFVRPLPHIAVLQDELPQLFQDDDVGADEEEAELRGEHTLTEKFVCLDDSFGHDCSLTCDDCRNGGTCLLGLDGCDCPEGWTGLICNETCPPDTFGKNCSFSCSCQNGGTCDSVTGACRCPPGVSGTNCEDGCPKGYYGKHCRKKCNCANRGRCHRLYGACLCDPGLYGRFCHLTCPPWAFGPGCSEECQCVQPHTQSCDKRDGSCSCKAGFRGERCQAECELGYFGPGCWQACTCPVGVACDSVSGECGKRCPAGFQGEDCGQECPVGTFGVNCSSSCSCGGAPCHGVTGQCRCPPGRTGEDCEADCPEGRWGLGCQEICPACQHAARCDPETGACLCLPGFVGSRCQDVCPAGWYGPSCQTRCSCANDGHCHPATGHCSCAPGWTGFSCQRACDTGHWGPDCSHPCNCSAGHGSCDAISGLCLCEAGYVGPRCEQQCPQGHFGPGCEQRCQCQHGAACDHVSGACTCPAGWRGTFCEHACPAGFFGLDCRSACNCTAGAACDAVNGSCLCPAGRRGPRCAETCPAHTYGHNCSQACACFNGASCDPVHGQCHCAPGWMGPSCLQACPAGLYGDNCRHSCLCQNGGTCDPVSGHCACPEGWAGLACEKECLPRDVRAGCRHSGGCLNGGLCDPHTGRCLCPAGWTGDKCQSPCLRGWFGEACAQRCSCPPGAACHHVTGACRCPPGFTGSGCEQACPPGSFGEDCAQMCQCPGENPACHPATGTCSCAAGYHGPSCQQRCPPGRYGPGCEQLCGCLNGGSCDAATGACRCPTGFLGTDCNLTCPQGRFGPNCTHVCGCGQGAACDPVTGTCLCPPGRAGVRCERGCPQNRFGVGCEHTCSCRNGGLCHASNGSCSCGLGWTGRHCELACPPGRYGAACHLECSCHNNSTCEPATGTCRCGPGFYGQACEHPCPPGFHGAGCQGLCWCQHGAPCDPISGRCLCPAGFHGHFCERGCEPGSFGEGCHQRCDCDGGAPCDPVTGLCLCPPGRSGATCNLDCRRGQFGPSCTLHCDCGGGADCDPVSGQCHCVDGYMGPTCREGGPLRLPENPSLAQGSAGTLPASSRPTSRSGGPARH

SEQ ID NO: 54185 - protein, 2845 aa, Homo sapiens
MALGKVLAMALVLALAVLGSLSPGARAGDCKGQRQVLREAPGFVTDGAGNYSVNGNCEWLIEAPSPQHRILLDFLFLDTECTYDYLFVYDGDSPRGPLLASLSGSTRPPPIEASSGKMLLHLFSDANYNLLGFNASFRFSLCPGGCQSHGQCQPPGVCACEPGWGGPDCGLQECSAYCGSHGTCASPLGPCRCEPGFLGRACDLHLWENQGAGWWHNVSARDPAFSARIGAAGAFLSPPGLLAVFGGQDLNNALGDLVLYNFSANTWESWDLSPAPAARHSHVAVAWAGSLVLMGGELADGSLTNDVWAFSPLGRGHWELLAPPASSSSGPPGLAGHAAALVDDVWLYVSGGRTPHDLFSSGLFRFRLDSTSGGYWEQVIPAGGRPPAATGHSMVFHAPSRALLVHGGHRPSTARFSVRVNSTELFHVDRHVWTTLKGRDGLQGPRERAFHTASVLGNYMVVYGGNVHTHYQEEKCYEDGIFFYHLGCHQWVSGAELAPPGTPEGRAAPPSGRYSHVAAVLGGSVLLVAGGYSGRPRGDLMAYKVPPFVFQAPAPDYHLDYCSMYTDHSVCSRDPECSWCQGACQAAPPPGTPLGACPAASCLGLGRLLGDCQACLAFSSPTAPPRGPGTLGWCVHNESCLPRPEQARCRGEQISGTVGWWGPAPVFVTSLEACVTQSFLPGLHLLTFQQPPNTSQPDKVSIVRSTTITLTPSAETDVSLVYRGFIYPMLPGGPGGPGAEDVAVWTRAQRLHVLARMARGPDTENMEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPFCEWHQSTSRKGDAACSRRGRGRGALKSPEECPPLCSQRLTCEDCLANSSQCAWCQSTHTCFLFAAYLARYPHGGCRGWDDSVHSEPRCRSCDGFLTCHECLQSHECGWCGNEDNPTLGRCLQGDFSGPLGGGNCSLWVGEGLGLPVALPARWAYARCPDVDECRLGLARCHPRATCLNTPLSYECHCQRGYQGDGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 54186 - protein, 2778 aa, Homo sapiens
MALGKVLAMALVLALAVLGSLSPGARAGDCKGQRQVLREAPGFVTDGAGNYSVNGNCEWLIEAPSPQHRILLDFLFLDTECTYDYLFVYDGDSPRGPLLASLSGSTRPPPIEASSGKMLLHLFSDANYNLLGFNASFRFSLCPGGCQSHGQCQPPGVCACEPGWGGPDCGLQECSAYCGSHGTCASPLGPCRCEPGFLGRACDLHLWENQGAGWWHNVSARDPAFSARIGAAGAFLSPPGLLAVFGGQDLNNALGDLVLYNFSANTWESWDLSPAPAARHSHVAVAWAGSLVLMGGELADGSLTNDVWAFSPLGRGHWELLAPPASSSSGPPGLAGHAAALVDDVWLYVSGGRTPHDLFSSGLFRFRLDSTSGGYWEQVIPAGGRPPAATGHSMVFHAPSRALLVHGGHRPSTARFSVRVNSTELFHVDRHVWTTLKGRDGLQGPRERAFHTASVLGNYMVVYGGNVHTHYQEEKCYEDGIFFYHLGCHQWVSGAELAPPGTPEGRAAPPSGRYSHVAAVLGGSVLLVAGGYSGRPRGDLMAYKVPPFVFQAPAPDYHLDYCSMYTDHSVCSRDPECSWCQGACQAAPPPGTPLGACPAASCLGLGRLLGDCQACLAFSSPTAPPRGPGTLGWCVHNESCLPRPEQARCRGEQISGTVGWWGPAPVFVTSLEACVTQSFLPGLHLLTFQQPPNTSQPDKEEVGRWVAHQEKETRRLQRPGSARLFPLPGRDHKYAVEIQGQLNGSAGPGHSELTLLWDRTGVPGGSEISFFFLEPYRSSSCTSYSSCLGCLADQGCGWCLTSATCHLRQGGAHCGDDGAGGSLLVLVPTLCPLCEEHRDCHACTQDPFCEWHQSTSRKGDAACSRRGRGRGALKSPEECPPLCSQRLTCEDCLANSSQCAWCQSTHTCFLFAAYLARYPHGGCRGWDDSVHSEPRCRSCDGFLTCHECLQSHECGWCGNEDNPTLGRCLQGDFSGPLGGGNCSLWVGEGLGLPVALPARWAYARCPDVDECRLGLARCHPRATCLNTPLSYECHCQRGYQGDGISHCNRTCLEDCGHGVCSGPPDFTCVCDLGWTSDLPPPTPAPGPPAPRCSRDCGCSFHSHCRKRGPGFCDECQDWTWGEHCERCRPGSFGNATGSRGCRPCQCNGHGDPRRGHCDNLSGLCFCQDHTEGAHCQLCSPGYYGDPRAGGSCFRECGGRALLTNVSSVALGSRRVGGLLPPGGGAARAGPGLSYCVWVVSATEELQPCAPGTLCPPLTLTFSPDSSTPCTLSYVLAFDGFPRFLDTGVVQSDRSLIAAFCGQRRDRPLTVQALSGLLVLHWEANGSSSWGFNASVGSARCGSGGPGSCPVPQECVPQDGAAGAGLCRCPQGWAGPHCRMALCPENCNAHTGAGTCNQSLGVCICAEGFGGPDCATKLDGGQLVWETLMDSRLSADTASRFLHRLGHTMVDGPDATLWMFGGLGLPQGLLGNLYRYSVSERRWTQMLAGAEDGGPGPSPRSFHAAAYVPAGRGAMYLLGGLTAGGVTRDFWVLNLTTLQWRQEKAPQTVELPAVAGHTLTARRGLSLLLVGGYSPENGFNQQLLEYQLATGTWVSGAQSGTPPTGLYGHSAVYHEATDSLYVFGGFRFHVELAAPSPELYSLHCPDRTWSLLAPSQGAKRDRMRNVRGSSRGLGQVPGEQPGSWGFREVRKKMALWAALAGTGGFLEEISPHLKEPRPRLFHASALLGDTMVVLGGRSDPDEFSSDVLLYQVNCNAWLLPDLTRSASVGPPMEESVAHAVAAVGSRLYISGGFGGVALGRLLALTLPPDPCRLLSSPEACNQSGACTWCHGACLSGDQAHRLGCGGSPCSPMPRSPEECRRLRTCSECLARHPRTLQPGDGEASTPRCKWCTNCPEGACIGRNGSCTSENDCRINQREVFWAGNCSEAACGAADCEQCTREGKCMWTRQFKRTGETRRILSVQPTYDWTCFSHSLLNVSPMPVESSPPLPCPTPCHLLPNCTSCLDSKGADGGWQHCVWSSSLQQCLSPSYLPLRCMAGGCGRLLRGPESCSLGCAQATQCALCLRRPHCGWCAWGGQDGGGRCMEGGLSGPRDGLTCGRPGASWAFLSCPPEDECANGHHDCNETQNCHDQPHGYECSCKTGYTMDNMTGLCRPVCAQGCVNGSCVEPDHCRCHFGFVGRNCSTECRCNRHSECAGVGARDHCLLCRNHTKGSHCEQCLPLFVGSAVGGGTCRPCHAFCRGNSHICISRKELQMSKGEPKKYSLDPEEIENWVTEGPSEDEAVCVNCQNNSYGEKCESCLQGYFLLDGKCTKCQCNGHADTCNEQDGTGCPCQNNTETGTCQGSSPSDRRDCYKYQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 54187 - protein, 439 aa, Homo sapiens
MRELPAGLLPPGREVHQCAKCRESFHGSPLGGQQCYRLISVEQECCLDPTSQTNCFHEPKRRALGPGRTVLFGVQPKFTNVDIRLTLDVTFGAVDLYVSTSYDTFVVRVAPDTGVHTVHIQPPPAPPPPPPPADGGPRGAGDPGGAGASSGPGAPAEPRVREVWPRGLITYVTVTEPSAVLVVRGVRDRLVITYPHEHHALKSSRFYLLLLGVGDPSGPGANGSADSQGLLFFRQDQAHIDLFVFFSVFFSCFFLFLSLCVLLWKAKQALDQRQEQRRHLQEMTKMASRPFAKVTVCFPPDPTAPASAWKPAGLPPPAFRRSEPFLAPLLLTGAGGPWGPMGGGCCPPAIPATTAGLRAGPITLEPTEDGMAGVATLLLQLPGGPHAPNGACLGSALVTLRHRLHEYCGGGGGAGGSGHGTGAGRKGLLSQDNLTSMSL

SEQ ID NO: 54188 - protein, 602 aa, Homo sapiens
MNGGAERAMRSLPSLGGLALLCCAAAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 54189 - protein, 639 aa, Homo sapiens
MRSLPSLGGLALLCCAAAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPGHQWPVAKMPQKYLGKYACESNLKSKYLPLTQPVMNLRVSEAVKTEYVCNCSVVGSLNVNRCNQTTGQCECRPGYQGLHCETCKEGFYLNYTSGLCQPCDCSPHGALSIPCNSSGKCQCKVGVIGSICDRCQDGYYGFSKNGCLPCQCNNRSASCDALTGACLNCQENSKGNHCEECKEGFYQSPDATKECLRCPCSAVTSTGSCSIKSSELEPECDQCKDGYIGPNCNKCENGYYNFDSICRKCQCHGHVDPVKTPKICKPESGECINCLHNTTGFWCENCLEGYVHDLEGNCIKKEVILPTPEGSTILVSNASLTTSVPTPVINSTFTPTTLQTIFSVSTSENSTSALADVSWTQFNIIILTVIIIVVVLLMGFVGAVYMYREYQNRKLNAPFWTIELKEDNISFSSYHDSIPNADVSGLLEDDGNEVAPNGQLTLTTPIHNYKA

SEQ ID NO: 54190 - protein, 312 aa, Homo sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNAGLSQFLLQSSSSLVMQRLFFHCFLSWATSKTRNP

SEQ ID NO: 54191 - protein, 487 aa, Homo sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 54192 - protein, 286 aa, Homo sapiens
MCLFQLCGLVRYMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 54193 - protein, 346 aa, Homo sapiens
MDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTGPEMQNILKKVAATLQVPVNDLNADLIQVAFFTCSFDLAIKGVKSPWCDVFDIDDAKVLEYLNDLKQYWKRGYGYTINSRSSCTLFQDIFQHLDKAVEQKQRSQPISSPVILQFGHAETLLPLLSLMGYFKDKEPLTAYNYKKQMHRKFRSGLIVPYASNLIFVLYHCENAKTPKEQFRVQMLLNEKVLPLAYSQETVSFYEDLKNHYKDILQSCQTSEECELARANSTSDEL

SEQ ID NO: 54194 - protein, 2070 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 54195 - protein, 2070 aa, Homo sapiens; identical to SEQ ID NO: 54194

SEQ ID NO: 54196 - protein, 2041 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRKSPLPSLLHNLYPKYNFSSTNPFADSLQINADKAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 54197 - protein, 1950 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 54198 - protein, 304 aa, Homo sapiens
MQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 54199 - protein, 2041 aa, Homo sapiens; identical to SEQ ID NO: 54196

SEQ ID NO: 54200 - protein, 2037 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKCSLGTVTLEVGRIKAGPFHSERRPSQSSQVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 54201 - protein, 2008 aa, Homo sapiens
MLEAIDKNRALHAAERLQTKLRERGDVANEDKLSLLKSVLQSPLFSQILSLQTSVQQLKDQVNIATSATSNIEYAHVPHLSPAVIPTLQNESFLLSPNNGNLEALTGPGIPHINGKPACDEFDQLIKNMAQGRHVEVFELLKPPSGGLGFSVVGLRSENRGELGIFVQEIQEGSVAHRDGRLKETDQILAINGQALDQTITHQQAISILQKAKDTVQLVIARGSLPQLVSPIVSRSPSAASTISAHSNPVHWQHMETIELVNDGSGLGFGIIGGKATGVIVKTILPGGVADQHGRLCSGDHILKIGDTDLAGMSSEQVAQVLRQCGNRVKLMIARGAIEERTAPTALGITLSSSPTSTPELRVDASTQKGEESETFDVELTKNVQGLGITIAGYIGDKKLEPSGIFVKSITKSSAVEHDGRIQIGDQIIAVDGTNLQGFTNQQAVEVLRHTGQTVLLTLMRRGMKQEAELMSREDVTKDADLSPVNASIIKENYEKDEDFLSSTRNTNILPTEEEGYPLLSAEIEEIEDAQKQEAALLTKWQRIMGINYEIVVAHVSKFSENSGLGISLEATVGHHFIRSVLPEGPVGHSGKLFSGDELLEVNGITLLGENHQDVVNILKELPIEVTMVCCRRTVPPTTQSELDSLDLCDIELTEKPHVDLGEFIGSSETEDPVLAMTDAGQSTEEVQAPLAMWEAGIQHIELEKGSKGLGFSILDYQDPIDPASTVIIIRSLVPGGIAEKDGRLLPGDRLMFVNDVNLENSSLEEAVEALKGAPSGTVRIGVAKPLPLSPEEGYVSAKEDSFLYPPHSCEEAGLADKPLFRADLALVGTNDADLVDESTFESPYSPENDSIYSTQASILSLHGSSCGDGLNYGSSLPSSPPKDVIENSCDPVLDLHMSLEELYTQNLLQRQDENTPSVDISMGPASGFTINDYTPANAIEQQYECENTIVWTESHLPSEVISSAELPSVLPDSAGKGSEYLLEQSSLACNAECVMLQNVSKESFERTINIAKGNSSLGMTVSANKDGLGMIVRSIIHGGAISRDGRIAIGDCILSINEESTISVTNAQARAMLRRHSLIGPDIKITYVPAEHLEEFKISLGQQSGRVMALDIFSSYTGRDIPELPEREEGEGEESELQNTAYSNWNQPRRVELWREPSKSLGISIVGGRGMGSRLSNGEVMRGIFIKHVLEDSPAGKNGTLKPGDRIVEVDGMDLRDASHEQAVEAIRKAGNPVVFMVQSIINRPRAPSQSESEPEKAPLCSVPPPPPSAFAEMGSDHTQSSASKISQDVDKEDEFGYSWKNIRERYGTLTGELHMIELEKGHSGLGLSLAGNKDRSRMSVFIVGIDPNGAAGKDGRLQIADELLEINGQILYGRSHQNASSIIKCAPSKVKIIFIRNKDAVNQMAVCPGNAVEPLPSNSENLQNKETEPTVTTSDAAVDLSSFKNVQHLELPKDQGGLGIAISEEDTLSGVIIKSLTEHGVAATDGRLKVGDQILAVDDEIVVGYPIEKFISLLKTAKMTVKLTIHAENPDSQAVPSAAGAASGEKKNSSQSLMVPQSGSPEPESIRNTSRSSTPAIFASDPATCPIIPGCETTIEISKGRTGLGLSIVGGSDTLLGAIIIHEVYEEGAACKDGRLWAGDQILEVNGIDLRKATHDEAINVLRQTPQRVRLTLYRDEAPYKEEEVCDTLTIELQKKPGKGLGLSIVGKRNDTGVFVSDIVKGGIADADGRLMQGDQILMVNGEDVRNATQEAVAALLKVSEGSLSSFTFPLSGSSTSESLESSSKKNALASEIQGLRTVEMKKGPTDSLGISIAGGVGSPLGDVPIFIAMMHPTGVAAQTQKLRVGDRIVTICGTSTEGMTHTQAVNLLKNASGSIEMQVVAGGDVSVVTGHQQEPASSSLSFTGLTSSSIFQDDLGPPQCKSITLERGPDGLGFSIVGGYGSPHGDLPIYVKTVFAKGAASEDGRLKRGDQIIAVNGQSLEGVTHEEAVAILKRTKGTVTLMVLS

SEQ ID NO: 54202 - protein, 362 aa, Homo sapiens
METDAPQPGLASPDSPHDPCKMFIGGLSWQTTQEGLREYFGQFGEVKECLVMRDPLTKRSRGFGFVTFMDQAGVDKVLAQSRHELDSKTIDPKVAFPRRAQPKMVTRTKKIFVGGLSVNTTVEDVKQYFEQFGKVDDAMLMFDKTTNRHRGFGFVTFESEDIVEKVCEIHFHEINNKMVECKKAQPKEVMSPTGSARGRSRVMPYGMDAFMLGIGMLGYPGFQATTYASRSYTGLAPGYTYQFPEFRVERTPLPSAPVLPELTAIPLTAYGPMAAAAAAAAVVRGTGSHPWTMAPPPGSTPSRTGGFLGTTSPGPMAELYGAANQDSGVSSYISAASPAPSTGFGHSLGGPLIATAFTNGYH

SEQ ID NO: 54203 - protein, 208 aa, Homo sapiens [sequence omitted]

SEQ ID NO: 54204 - protein, 208 aa, Homo sapiens [sequence omitted]

SEQ ID NO: 54205 - protein, 132 aa, Homo sapiens
MREQYMRTGDGFLIVYSVTDKASFEHVDRFHQLILRVKDRESFPMILVANKVDLMHLRKITREQGKEMATKHNIPYIETSAKDPPLNVDKAFHDLVRVIRQQIPEKSQKKKKKTKWRGDRATGTHKLQCVIL

SEQ ID NO: 54206 - protein, 208 aa, Homo sapiens [sequence omitted]

SEQ ID NO: 54207 - protein, 23 aa, Homo sapiens
MATSAVPSDNLPTYKLVVVGDGG

SEQ ID NO: 54208 - protein, 875 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEMLFISSFSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 54209 - protein, 189 aa, Homo sapiens [sequence omitted]

SEQ ID NO: 54210 - protein, 116 aa, Homo sapiens
MKPKITRPPINVKIIEGLKAVLPCTTMGNPKPSVSWIKGDSPLRENSRIAVLESGSLRIHNVQKEDAGQYRCVAKNSLGTAYSKVVKLEVEGAKGIHTQFVASALQLRSFLSCPQI

SEQ ID NO: 54211 - protein, 116 aa, Homo sapiens; identical to SEQ ID NO: 54210

SEQ ID NO: 54212 - protein, 189 aa, Homo sapiens [sequence omitted]

SEQ ID NO: 54213 - protein, 783 aa, Homo sapiens [sequence omitted]

SEQ ID NO: 54214 - protein, 869 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEWSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 54215 - protein, 867 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAEMLFISSFSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLAFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 54216 - protein, 869 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEVFARILRAPESHNVTFGSFVTLHCTATGIPVPTITWIENGNAVSSGSIQESVKDRVIDSRLQLFITKPGLYTCIATNKHGEKFSTAKAAATISIAAFSKPQKDNKGYCAQYRGEVCNAVLAKDALVFLNTSYADPEEAQELLVHTAWNELKVVSPVCRPAAEALLCNHIFQECSPGVVPTPIPICREYCLAVKELFCAKEWLVMEEKTHRGLYRSEMHLLSVPECSKLPSMHWDPTACARLPHLDYNKENLKTFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 54217 - protein, 783 aa, Homo sapiens
MRELVNIPLVHILTLVAFSGTEKLPKAPVITTPLETVDALVEEVATFMCAVESYPQPEISWTRNKILIKLFDTRYSIRENGQLLTILSVEDSDDGIYCCTANNGVGGAVESCGALQVKMKPKITRPPINVKIIEGLKAVLPCTTMGNPKPSVSWIKGDSPLRENSRIAVLESGSLRIHNVQKEDAGQYRCVAKNSLGTAYSKVVKLEVEEESEPEQDTKVFARILRAPESHNVTFGSFVTLHCTATGIPVPTITWIENGNAVSSGSIQESVKDRVIDSRLQLFITKPGLYTCIATNKHGEKFSTAKAAATISIAAWKKYCLAVKELFCAKEWLVMEEKTHRGLYRSEMHLLSVPECSKLPSMHWDPTACARLPHLAFPPMTSSKPSVDIPNLPSSSSSSFSVSPTYSMTVIISIMSSFAIFVLLTITTLYCCRRRKQWKNKKRESAAVTLTTLPSELLLDRLHPNPMYQRMPLLLNPKLLSLEYPRNNIEYVRDIGEGAFGRVFQARAPGLLPYEPFTMVAVKMLKEEASADMQADFQREAALMAEFDNPNIVKLLGVCAVGKPMCLLFEYMAYGDLNEFLRSMSPHTVCSLSHSDLSMRAQVSSPGPPPLSCAEQLCIARQVAAGMAYLSERKFVHRDLATRNCLVGENMVVKIADFGLSRNIYSADYYKANENDAIPIRWMPPESIFYNRYTTESDVWAYGVVLWEIFSYGLQPYYGMAHEEVIYYVRDGNILSCPENCPVELYNLMRLCWSKLPADRPSFTSIHRILERMCERAEGTVSV

SEQ ID NO: 54218 - protein, 388 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 54219 - protein, 302 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 54220 - protein, 340 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMFPWCTVLRQPLCPQQQHLPQVFPSLQQPQPTSPILDASTLLGATSCPAAAGKMIPIISAEHLTSHKYVTQM

SEQ ID NO: 54221 - protein, 382 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 54222 - protein, 370 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPVPMVHGATPATVSAATTSATSVPFAATATANQIPIISAEHLTSHKYVTQM

SEQ ID NO: 54223 - protein, 342 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVDTHNICRTSD

SEQ ID NO: 54224 - protein, 388 aa, Homo sapiens; identical to SEQ ID NO: 54218

SEQ ID NO: 54225 - protein, 340 aa, Homo sapiens; identical to SEQ ID NO: 54220

SEQ ID NO: 54226 - protein, 302 aa, Homo sapiens; identical to SEQ ID NO: 54219

SEQ ID NO: 54227 - protein, 342 aa, Homo sapiens; identical to SEQ ID NO: 54223

SEQ ID NO: 54228 - protein, 343 aa, Homo sapiens
MGRCSRENCKYLHPPPHLKTQLEINGRNNLIQQKNMAMLAQQMQLANAMMPGAPLQPVPMFSVAPSLATNASAAAFNPYLGPVSPSLVPAEILPTAPMLVTGNPGVPVPAAAAAAAQKLMRTDRLEVCREYQRGNCNRGENDCRFAHPADSTMIDTNDNTVTVCMDYIKGRCSREKCKYFHPPAHLQAKIKAAQYQVNQAAAAQAAATAAAMTQSAVKSLKRPLEATFDLGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 54229 - protein, 314 aa, Homo sapiens
MAVSVTPIRDTKWLTLEVCREFQRGTCSRPDTECKFAHPSKSCQVENGRVIACFDSLKGRCSRENCKYLHPPPHLKTQLEINGRNNLIQQKNMAMLAQQMQLANAMMPGAPLQPVVCREYQRGNCNRGENDCRFAHPADSTMIDTNDNTVTVCMDYIKGRCSREKCKYFHPPAHLQAKIKAAQYQVNQAAAAQAAATAAAMGIPQAVLPPLPKRPALEKTNGATAVFNTGIFQYQQALANMQLQQHTAFLPPGSILCMTPATSVVPMVHGATPATVSAATTSATSVPFAATATANQIPIISAEHLTSHKYVTQM

SEQ ID NO: 54230 - protein, 334 aa, Homo sapiens
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALTNLQLPQPAFIPAGPILCMAPASNIVPMMHGATPTTVSAATTPATSVPFAAPTTGNQIPQLSIDELNSSMFVSQM

SEQ ID NO: 54231 - protein, 258 aa, Homo sapiens
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 54232 - protein, 304 aa, Homo sapiens
MERASKNLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 54233 - protein, 354 aa, Homo sapiens
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQLKF

SEQ ID NO: 54234 - protein, 342 aa, Homo sapiens
MTAVNVALIRDTKWLTLEVCREFQRGTCSRADADCKFAHPPRVCHVENGRVVACFDSLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAVPMMHGATPTTVSAATTPATSVPFAAPTTGNQLKF

SEQ ID NO: 54235 - protein, 258 aa, Homo sapiens; identical to SEQ ID NO: 54231

SEQ ID NO: 54236 - protein, 223 aa, Homo sapiens
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNI

SEQ ID NO: 54237 - protein, 242 aa, Homo sapiens
MFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPA

SEQ ID NO: 54238 - protein, 150 aa, Homo sapiens
IKGRCSREKCKYFHPPAHLQARLKAAHHQMNHSAASAMALQPGTLQLIPKRSALEKPNGATPVFNPTVFHCQQALTNLQLPQPAFIPAGPILCMAPASNIVPMMHGATPTTVSAATTPATSVPFAAPTTGNQIPQLSIDELNSSMFVSQM

SEQ ID NO: 54239 - protein, 292 aa, Homo sapiens
MERASKNLKGRCTRENCKYLHPPPHLKTQLEINGRNNLIQQKTAAAMFAQQMQLMLQNAQMSSLGSFPMTPSIPANPPMAFNPYIPHPGMGLVPAELVPNTPVLIPGNPPLAMPGAVGPKLMRSDKLEVCREFQRGNCTRGENDCRYAHPTDASMIEASDNTVTICMDYIKGRCSREKCKYFHPPAHLQARLKAAHHQMNHSAASAMALQPGTLQLIPKRSALEKPNGATPVFNPTVFHCQQALTNLQLPQPAFIPAVPMMHGATPTTVSAATTPATSVPFAAPTTGNQLKF

SEQ ID NO: 54240 - protein, 458 aa, Homo sapiens
MELEKREKRSLLNKNLEEKLTVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQQYKTKSSYKAFAAIPTNTLLLEQKALDEPAKTESVSKDNTLEPPVELYFPAQLRQQTEELCATIDKVLQDSLSMHSSDSPSRSPKTLLGSDTVKTPTTLPRAAGRETKYANLSSPSSTVSESQLTKPGVIRPVPVKSRILLKKEEEVYEPNPFSKYLEDNSDLFSEQDVTVPPKPVSLHPLYQTKLYPPAKSLLHPQTLSHADCLAPGPFSHLSFSLSDEQENSHTLLSHNACNKLSHPMVAIPEHEALDSKEQ

SEQ ID NO: 54241 - protein, 290 aa, Homo sapiens
MTSCILSGSIQTTPQVSAGGSEAKPLIFTFVPTVRRLPTHTQLADTSKFLVKIPEESSDKSPETVNRSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQTPTTLPRAAGRETKYANLSSPSSTVSESQLTKPGVIRPVPVKSRILLKKEEEVYEPNPFSKYLEDNSDLFSEQLSHPMVAIPEHEALDSKEQ

SEQ ID NO: 54242 - protein, 234 aa, Homo sapiens
MCSWYLGFECSSKSNDYLTLNAGSQQERDQAKLTCPSEVSGTILQEREFEANKLQGMQQSDLFKAEYVLIVDSEGEDEAASRKVEQGPPGGIGTAAVRPKSLAISSSLVSDVVRPKTQGTDLKTSSHPEMLHGMAPQQKHGQTPTTLPRAAGRETKYANLSSPSSTVSESQLTKPGVIRPVPVKSRILLKKEEEVYEPNPFSKYLEDNSDLFSEQLSHPMVAIPEHEALDSKEQ

SEQ ID NO: 54243 - protein, 162 aa, Homo sapiens
MQQSDLFKAEYVLIVDSEGEDEAASRKVEQGPPGGIGTAAVRPKSLAISSSLVSDVVRPKTQGTDLKTSSHPEMLHGMAPQQKHGQQYKTKSSYKAFAAIPTNTLLLEQKALDEPAKTESVSKDNTLEPPVETPTTLPRAAGRETKYANLSSPSSTVSESQL

SEQ ID NO: 54244 - protein, 735 aa, Homo sapiens
MAAGGAVAAAPECRLLPYALHKWSSFSSTYLPENILVDKPNDQSSRWSSESNYPPQYLILKLERPAIVQNITFGKYEKTHVCNLKKFKVFGGMNEENMTELLSSGLKNDYNKETFTLKHKIDEQMFPCRFIKIVPLLSWGPSFNFSIWYVELSGIDDPDIVQPCLNWYSKYREQEAIRLCLKHFRQHNYTEAFESLQKKTKIALEHPMLTDIHDKLVLKGDFDACEELIEKAVNDGLFNQYISQQEYKPRWSQIIPKSTKGDGEDNRPGMRGGHQMVIDVQTETVYLFGGWDGTQDLADFWAYSVKENQWTCISRDTEKENGPSARSCHKMCIDIQRRQIYTLGRYLDSSVRNSKSLKSDFYRYDIDTNTWMLLSEDTAADGGPKLVFDHQMCMDSEKHMIYTFGGRILTCNGSVDDSRASEPQFSGLFAFNCQCQTWKLLREDSCNAGPEDIQSRIGHCMLFHSKNRCLYVFGGQRSKTYLNDFFSYDVDSDHVDIISDGTKKDSGMVPMTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEFQLLASALFKSGSDFTALGFSDVDHTYAQRTQLFDTLVNFFPDSMTPPKGNLVDLITL

SEQ ID NO: 54245 - protein, 185 aa, Homo sapiens
MTGFTQRATIDPELNEIHVLSGLSKDKEKREENVRNSFWIYDIVRNSWSCVYKNDQAAKDNPTKSLQEEEPCPRFAHQLVYDELHKVHYLFGGNPGKSCSPKMRLDDFWSLKLCRPSKDYLLRHCKYLIRKHRFEEKAQVDPLSALKYLQNDLYITVDHSDPEETKEAFLMWITPMLKELSSLTP

SEQ ID NO: 54246 - protein, 1019 aa, Homo sapiens
MMAAAAAAAAGSSSSGGGGGGSGSSSSSSDTSSTGEEERMRRLFQTCDGDGDGYISRNDLLMVCRQLNMEESVAEIMNQLGADENGKISFQDFTRCRMQLVREIRKEEVDLSAKSDNSCTKKLRDRIASWPTSSDNSLGALSAARESWEYDSGARDLQSPDVQSQSALQKLLEYGGSSLHQQAALHKLLTQSPHIGNSVGGSYLELANTLHSAALASLKGDIVELNKRLQQTERERDLLEKKLAKAQCEQSHLMREHEDVQERTTLRYEERITELHSVIAELNKKIDRLQGTTIREEDEYSELRSELSQSQHEVNEDSRSMDQDQTSVSIPENQSTMVTADMDNCSDLNSELQRVLTGLENVVCGRKKSSCSLSVAEVDKHIEQLTTASEHCDLAIKTVEEIEGVLGRDLYPNLAEERSRWEKELAGLREENESLTAMLCSKEEELNRTKATMNAIREERDRLRRRVRELQTRLQSVQATGPSSPGRLTSTNRPINPSTGELSTSSSSNDIPIAKIAERVKLSKTRSESSSSDRPVLGSEISSIGVSSSVAEHLAHSLQDCSNIQEIFQTLYSHGSAISESKIREFEVETERLNSRIEHLKSQNDLLTITLEECKSNAERMSMLVGKYESNATALRLALQYSEQCIEAYELLLALAESEQSLILGQFRAAGVGSSPGDQSGDENITQMLKRAHDCRKTAENAAKALLMKLDGSCGGAFAVAGCSVQPWESLSSNSHTSTTSSTASSCDTEFTKEDEQRLKDYIQQLKNDRAAVKLTMLELESIHIDPLSYDVKPRGDSQRLDLENAVLMQELMAMKEEMAELKAQLYLLEKEKKALELKLSTREAQEQAYLVHIEHLKSEVEEQKEQRMRSLSSTSSGSKDKPGKECADAASPALSLAELRTTCSENELAAEFTNAIRREKKLKARVQELVSALERLTKSSEIRHQQSAEFVNDLKRANSNLVAAYEKAKKKHQNKLKKLESQMMAMVERHETQVRMLKQRIALLEEENSRPHTNETSL

SEQ ID NO: 54247 - protein, 187 aa, Homo sapiens
MSGGGTETPVGCEAAPGGGSKKRDSLGTAGSAHLIIKDLGEIHSRLLDHRPVIQGETRYFVKEFEEKRGLREMRVLENLKNMIHETNEHTLPKCRDTMRDSLSQVLQRLQAANDSVCRLQQREQERKKIHSDHLVASEKQHMLQWDNFMKEQPNKRAEVDEEHRKAMERLKEQYAEMEKDLAKFSTF

SEQ ID NO: 54248 - protein, 123 aa, Homo sapiens
MEKRGLREMRVLENLKNMIHETNEHTLPKCRDTMRDSLSQVLQRLQAANDSVCRLQQREQERKKIHSDHLVASEKQHMLQWDNFMKEQPNKRAEVDEEHRKAMERLKEQYAEMEKDLAKFSTF

SEQ ID NO: 54249 - protein, 1328 aa, Homo sapiens
MESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQVRKAGKP

SEQ ID NO: 54250 - protein, 1332 aa, Homo sapiens
MESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKHPFSFPLENQAREAVSSAFFSLLQTLSTQFKQAPGQTQGGQPWTYHLVQFADLLLNHSHNVTTVTPFTAQQRQAWDRMLQTLKELEAHSAEARAAAFQHLLLLVGIHLLKSPAESCDLLGDIQTCIRKSLGEKPRRSRTKTIDPQEPPWVEVLVEILLALLAQPSHLMRQVARSVFGHICSHLTPRALQLILDVLNPETSEDENDRVVVTDDSDERRLKGAEDKSEEGEDNRSSESEEESEGEESEEEERDGDVDQGFREQLMTVLQAGKALGGEDSENEEELGDEAMMALDQSLASLFAEQKLRIQARRDEKNKLQKEKALRRDFQIRVLDLVEVLVTKQPENALVLELLEPLLSIIRRSLRSSSSKQEQDLLHKTARIFTHHLCRARRYCHDLGERAGALHAQVERLVQQAGRQPDSPTALYHFNASLYLLRVLKGNTAEGCVHETQEKQKAGTDPSHMPTGPQAASCLDLNLVTRVYSTALSSFLTKRNSPLTVPMFLSLFSRHPVLCQSLLPILVQHITGPVRPRHQACLLLQKTLSMREVRSCFEDPEWKQLMGQVLAKVTENLRVLGEAQTKAQHQQALSSLELLNVLFRTCKHEKLTLDLTVLLGVLQGQQQSLQQGAHSTGSSRLHDLYWQAMKTLGVQRPKLEKKDAKEIPSATQSPISKKRKKKGFLPETKKRKKRKSEDGTPAEDGTPAATGGSQPPSMGRKKRNRTKAKVPAQANGTPTTKSPAPGAPTRSPSTPAKSPKLQKKNQKPSQVNGAPGSPTEPAGQKQHQKALPKKGVLGKSPLSALARKKARLSLVIRSPSLLQSGAKKKAQTLRFTISSSKK

SEQ ID NO: 54251 - protein, 603 aa, Homo sapiens
MESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAASSVKKDRKLPAIALDLLRLALKEDKFPRFWKEVVEQGLLKMQFWPASYLCFRLLGAALPLLTKEQLHLVMQGDVIRHYGEHVCTAKLPKQFKFAPEMDDYVGTFLEGCQDDPERQLAVLVAFSSVTNQGLPVTPTFWRVVRFLSPPALQGYVAWLRAMFLQPDLDSLVDFSTNNQKKAQDSSLHMPERAVFRLRKWIIFRLVSIVDSLHLEMEEALTEQVARFCLFHSFFVTKKPTSQIPETKPQERSEGPAQPPHAPGGPERPKLEKKDAKEIPSAEDGTPAATGGSQPPSMGRKKRNRTKAKVPAQANGTPTTKSPAPGAPTRSPSTPAKSPKLQKKAQVRKAGKP

SEQ ID NO: 54252 - protein, 828 aa, Homo sapiens
MAAEEADVDIEGDVVAAAGAQPGSGENTASVLQKDHYLDSSWRTENGLIPWTLDNTISEENRAVIEKMLLEEEYYLSKKSQPEKVWLDQKEDDKKYMKSLQKTAKIMVHSPTKPASYSVKWTIEEKELFEQGLAKFGRRWTKISKLIGSRTVLQVKSYARQYFKNKVKCGLDKETPNQKTGHNLQVKNEDKGTKAWTPSCLRGRADPNLNAVKIEKLSDDEEVDITDEVDELSSQTPQKNSSSDLLLDFPNSKMHETNQGEFITSDSQEALFSKSSRGCLQNEKQDETLSSSEITLWTEKQSNGDKKSIELNDQKFNELIKNCNKHDGRGIIVDARQLPSPEPCEIQKNLNDNEMLFHSCQMVEESHEEEELKPPEQEIEIDRNIIQEEEKQAIPEFFEGRQAKTPERYLKIRNYILDQWEICKPKYLNKTSVRPGLKNCGDVNCIGRIHTYLELIGAINFGCEQAVYNRPQTVDKVRIRDRKDAVEAYQLAQRLQSMRTRRRRVRDPWGNWCDAKDLEGQTFEHLSAEELAKRREEEKGRPVKSLKVPRPTKSSFDPFQLIPCNFFSEEKQEPFQVKVASEALLIMDLHAHVSMAEVIGLLGGRYSEVDKVVEVCAAEPCNSLSTGLQCEMDPVSQTQASETLAVRGFSVIGWYHSHPAFDPNPSLRDIDTQAKYQSYFSRGGAKFIGMIVSPYNRNNPLPYSQITCLVISEEISPDGSYRLPYKFEVQQMLEEPQWGLVFEKTRWIIEKYRLSHSSVPMDKIFRRDSDLTCLQKLLECMRKTLSKVTNCFMAEEFLTEIENLFLSNYKSNQENGVTEENCTKELLM

SEQ ID NO: 54253 - protein, 280 aa, Homo sapiens
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNDAGARMRRCDLRAIAPQK

SEQ ID NO: 54254 - protein, 465 aa, Homo sapiens
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLQVESTTVATRRLSGFLRTLADRLEGTKELLSSDMKKDFIMHRLPPYSAGDGAELSTPGGKLPRLDSVVRLQFKDHIVLTVLPDQDQSDEAQEKMVYIYHSLKNSRETHMMGNEEETEFHGLRFPLSHLDALKQIWNSPAISVKDLKLTTDEEKESLVLSLWTECLIQVV

SEQ ID NO: 54255 - protein, 464 aa, Homo sapiens
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKVLNKDGKAHFLQLRKDFDQKRATIQFHQPQRFKDELWRIQEKLECYFGSLVGSNVYITPAGSQGLPPHYDDVEVFILQLEGEKHWRLYHPTVPLAREYSVEAEERIGRPVHEFMLKPGDLLYFPRGTIHQADTPAGLAHSTHVTISTYQNNSWGDFLLDTISGLVFDTAKEDVELRTGIPRQLLLVESTTVATRRLSGFLRTLADRLEGTKELLSSDMKKDFIMHRLPPYSAGDGAELSTPGGKLPRLDSVVRLQFKDHIVLTVLPDQDQSDEAQEKMVYIYHSLKNSRETHMMGNEEETEFHGLRFPLSHLDALKQIWNSPAISVKDLKLTTDEEKESLVLSLWTECLIQVV

SEQ ID NO: 54256 - protein, 465 aa, Homo sapiens; identical to SEQ ID NO: 54254

SEQ ID NO: 54257 - protein, 211 aa, Homo sapiens
MLLQVPCNSWGDFLLDTISGLVFDTAKEDVELRTGIPRQLLLQVESTTVATRRLSGFLRTLADRLEGTKELLSSDMKKDFIMHRLPPYSAGDGAELSTPGGKLPRLDSVVRLQFKDHIVLTVLPDQDQSDEAQEKMVYIYHSLKNSRETHMMGNEEETEFHGLRFPLSHLDALKQIWNSPAISVKDLKLTTDEEKESLVLSLWTECLIQVV

SEQ ID NO: 54258 - protein, 112 aa, Homo sapiens
MPKKAKPTGSGKEEGPAPCKQMKLEAAGGPSALNFDSPSSLFESLISPIKTETFFKEFWEQKPLLIQRDDPALATYYGSLFKLTDLKSLCSRGMYYGRDVNVCRCVNGKKKV

SEQ ID NO: 54259 - protein, 493 aa, Homo sapiens
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGFTTAAYLRIHAVKDHGLQAPRADRILCKLCSVHCKTPAQLAGHMQTHLGGAAPPVPGDAPQPQPTC

SEQ ID NO: 54260 - protein, 477 aa, Homo sapiens
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 54261 - protein, 252 aa, Homo sapiens [sequence omitted]

SEQ ID NO: 54262 - protein, 454 aa, Homo sapiens
MDPSNWSSFIFQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGGGAAAVAAGGVVTTTASGKRIRKNHACEMCGKAFRDVYHLNRHKLSHSDEKPYQCPVCQQRFKRKDRMSYHVRSHDGAVHKPYNCSHCGKSFSRPDHLNSHVRQVHSTERPFKCEKCEAAFATKDRLRAHTVRHEEKVPCHVCGKMLSSAYISDHMKVHSQGPHHVCELCNKGTGEVCPMAAAAAAAAAAAAAAVAAPPTAVGSLSGAEGVPVSSQPLPSQPW

SEQ ID NO: 54263 - protein, 984 aa, Homo sapiens
MRAPARGTGCCGRSGGRWLAGAAQPRCLWAGGAGQRFMVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQSLHSEVRGLLDTLVTDLMVLADELSPIKNVEEALRLCR

SEQ ID NO: 54264 - protein, 942 aa, Homo sapiens
MVPGGTMKSLKKDSRLRITPTRLLEASENVKEKKRAKGPEQPTPTIQEEPEPVSNVLQGDDILALAIKKEDLKEQHIPRLTEKEDKRVITQKFIIRKLKPMDPRRKVCHLVARPANPDEATKPLDYSGPGDSFDGSDQILPHHILGSLQDFKRIALARGNTQLAERIPTSPCLMTLISAEGESKQKAPKEEKRPPWAPPPQHNFLKNWQRNTALRKKQQEALSEHLKKPVSELLMHTGETYRRIQEERELIDCTLPTRRDRKSWENSGFWSRLEYLGDEMTGLVMTKTKTQRGLMEPITHIRKPHSIRVETGLPAQRDASYRYTWDRSLFLIYRRKELQRIMEELDFSQQDIDGLEVVGKGWPFSAVTVEDYTVFERSQGSSSEDTAYLGTLASSSDVSMPILGPSLLFCGKPACWIRGSNPQDKRQVGIAAHLTFETLEGEKTSSELTVVNNGTVAIWYDWRRQHQPDTFQDLKKNRMQRFYFDNREGVILPGEIKTFTFFFKSLTAGVFREFWEFRTHPTLLGGAILQVNLHAVSLTQDVFEDERKVLESKLTAHEAVTVVREVLQELLMGVLTPERTPSPVDAYLTEEDLFRHRNPPLHYEHQVVQSLHQLWRQYMTLPAKAEEARPGDKEHVSPIATEKASVNAELLPRFRSPISETQVPRPENEALRESGSQKARVGTKSPQRKSIMEEILVEESPDVDSTKSPWEPDGLPLLEWNLCLEDFRKAVMVLPDENHREDALMRLNKAALELCQKPRPLQSNLLHQMCLQLWRDVIDSLVGHSMWLRSVLGLPEKETIYLNVPEEQDQKSPPIMEVKVPVGKAGKEERKGAAQEKKQLGIKDKEDKKGAKLLGKEDRPNSKKHKAKDDKKVIKSASQDRFSLEDPTPDIILSSQEPIDPLVMGKYTQSLHSEVHPGRCVPWENTMQGAFPSTTRCGGSCL

SEQ ID NO: 54265 - protein, 663 aa, Homo sapiens
RSRGAEATESKLSGGFRWTQKTSPTQGDSAITHSLYRMIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 54266 - protein, 582 aa, Homo sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESKEVSTLESH

SEQ ID NO: 54267 - protein, 626 aa, Homo sapiens
MIFLTALPLFWIMISASRGGHWGAWMPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 54268 - protein, 601 aa, Homo sapiens
MPSSISAFEGTCVSIPCRFDFPDELRPAVVHGVWYFNSPYPKNYPPVVFKSRTQVVHESFQGRSRLLGDLGLRNCTLLLSNVSPELGGKYYFRGDLGGYNQYTFSEHSVLDIVNTPNIVVPPEVVAGTEVEVSCMVPDNCPELRPELSWLGHEGLGEPAVLGRLREDEGTWVQVSLLHFVPTREANGHRLGCQASFPNTTLQFEGYASMDVKYPPVIVEMNSSVEAIEGSHVSLLCGADSNPPPLLTWMRDGTVLREAVAESLLLELEEVTPAEDGVYACLAENAYGQDNRTVGLSVMYAPWKPTVNGTMVAVEGETVSILCSTQSNPDPILTIFKEKQILSTVIYESELQLELPAVSPEDDGEYWCVAENQYGQRATAFNLSVEFAPVLLLESHCAAARDTVQCLCVVKSNPEPSVAFELPSRNVTVNESEREFVYSERSGLVLTSILTLRGQAQAPPRVICTARNLYGAKSLELPFQGAHRLMWAKIGPVGAVVAFAILIAIVCYITQTRRKKNVTESPSFSAGDNPPVLFSSDFRISGAPEKYESERRLGSERRLLGLRGEPPELDLSYSHSDLGKRPTKDSYTLTEELAEYAEIRVK

SEQ ID NO: 54269 - protein, 304 aa, Homo sapiens
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 54270 - protein, 186 aa, Homo sapiens
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 54271 - protein, 197 aa, Homo sapiens
MASQKRPSQRHGSKYLATASTMDHARHGFLPRHRDTGILDSIGRFFGGDRGAPKRGSGKVPWLKPGRSPLPSHARSQPGLCNMYKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 54272 - protein, 197 aa, Homo sapiens
MGNHAGKRELNAEKASTNSETNRGESEKKRNLGELSRTTSEDNEVFGEADANQNNGTSSQDTAVTDSKRTADPKNAWQDAHPADPGSRPHLIRLFSRDAPGREDNTFKDRPSESDELQTIQEDSAATSESLDVMASQKRPSQRHGSKYLATASTMDHARHGFLPRHRDTGILDSIGRFFGGDRGAPKRGSGKVSSEE

SEQ ID NO: 54273 - protein, 197 aa, Homo sapiens; identical to SEQ ID NO: 54272

SEQ ID NO: 54274 - protein, 160 aa, Homo sapiens
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGAEGQRPGFGYGGRASDYKSAHKGFKGVDAQGTLSKIFKLGGRDSRSGSPMARR

SEQ ID NO: 54275 - protein, 171 aa, Homo sapiens
MASQKRPSQRHGSKYLATASTMDHARHGFLPRHRDTGILDSIGRFFGGDRGAPKRGSGKDSHHPARTAHYGSLPQKSHGRTQDENPVVHFFKNIVTPRTPPPSQGKGRGLSLSRFSWGAEGQRPGFGYGGRASDYKSAHKGFKGVDAQGTLSKIFKLGGRDSRSGSPMARR

SEQ ID NO: 54276 - protein, 86 aa, Homo sapiens
MASQKRPSQRHGSKYLATASTMDHARHGFLPRHRDTGILDSIGRFFGGDRGAPKRGSGKDSHHPARTAHYGSLPQKSHGRTQDENP

SEQ ID NO: 54277 - protein, 295 aa, Homo sapiens [sequence omitted]

SEQ ID NO: 54278 - protein, 213 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFGQFLEELLFHLEALSG

SEQ ID NO: 54279 - protein, 131 aa, Homo sapiens
MASLSRPSLPSCLCSFLLLLLLQVSSSYADPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 54280 - protein, 206 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFVFHLEALSG

SEQ ID NO: 54281 - protein, 252 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELLFHLEALSG

SEQ ID NO: 54282 - protein, 171 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEVSHSVTQDWLQWHDHGSLQPPPPRLK

SEQ ID NO: 54283 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 54284 - protein, 131 aa, Homo sapiens [sequence omitted]

SEQ ID NO: 54285 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELRNPF

SEQ ID NO: 54286 - protein, 247 aa, Homo sapiens; identical to SEQ ID NO: 54285

SEQ ID NO: 54287 - protein, 229 aa, Homo sapiens [sequence omitted]

SEQ ID NO: 54288 - protein, 213 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFGQFLEELLFHLEALSG

SEQ ID NO: 54289 - protein, 224 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFESFGVLGPQVKEPKKTGQFLEELRNPF

SEQ ID NO: 54290 - protein, 224 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFESFGVLGPQVKEPKKTGQFLEELRNPF

SEQ ID NO: 54291 - protein, 229 aa, Homo sapiens [sequence omitted]

SEQ ID NO: 54292 - protein, 213 aa, Homo sapiens; identical to SEQ ID NO: 54278

SEQ ID NO: 54293 - protein, 179 aa, Homo sapiens
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFGQFLEELRNPF

SEQ ID NO: 54294 - protein, 131 aa, Homo sapiens [sequence omitted]

SEQ ID NO: 54295 - protein, 204 aa, Homo sapiens
SLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFVFHLEALSG

SEQ ID NO: 54296 - protein, 131 aa, Homo sapiens
MASLSRPSLPSCLCSFLLLLLLQVSSSYADPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRNPF

SEQ ID NO: 54297 - protein, 224 aa, Homo sapiens [sequence omitted]

SEQ ID NO: 54298 - protein, 224 aa, Homo sapiens [sequence omitted]

SEQ ID NO: 54299 - protein, 224 aa, Homo sapiens [sequence omitted]

SEQ ID NO: 54300 - protein, 252 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLVFLCLQYRLRGKLRAEIENLHRTFDPHFLRVPCWKITLFVIVPVLGPLVALIICYNWLHRRLAGQFLEELLFHLEALSG

SEQ ID NO: 54301 - protein, 247 aa, Homo sapiens; identical to SEQ ID NO: 54285

SEQ ID NO: 54302 - protein, 179 aa, Homo sapiens; identical to SEQ ID NO: 54293
  MOD_RES (1)..(1): Any amino acid

SEQ ID NO: 54303 - protein, 179 aa, Homo sapiens; identical to SEQ ID NO: 54293
  MOD_RES (1)..(1): Any amino acid

SEQ ID NO: 54304 - protein, 252 aa, Homo sapiens; identical to SEQ ID NO: 54300

SEQ ID NO: 54305 - protein, 229 aa, Homo sapiens [sequence omitted]

SEQ ID NO: 54306 - protein, 295 aa, Homo sapiens [sequence omitted]

SEQ ID NO: 54307 - protein, 213 aa, Homo sapiens; identical to SEQ ID NO: 54278

SEQ ID NO: 54308 - protein, 252 aa, Homo sapiens; identical to SEQ ID NO: 54300

SEQ ID NO: 54309 - protein, 179 aa, Homo sapiens; identical to SEQ ID NO: 54293
  MOD_RES (1)..(1): Any amino acid

SEQ ID NO: 54310 - protein, 295 aa, Homo sapiens [sequence omitted]

SEQ ID NO: 54311 - protein, 295 aa, Homo sapiens [sequence omitted]

SEQ ID NO: 54312 - protein, 131 aa, Homo sapiens [sequence omitted]

SEQ ID NO: 54313 - protein, 252 aa, Homo sapiens; identical to SEQ ID NO: 54300

SEQ ID NO: 54314 - protein, 247 aa, Homo sapiens; identical to SEQ ID NO: 54285

SEQ ID NO: 54315 - protein, 204 aa, Homo sapiens; identical to SEQ ID NO: 54295

SEQ ID NO: 54316 - protein, 295 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRKFSSLCYKQRIKSQERETEATRGRGGLLRDHIPRGKEELESLGGGKTPPGR

SEQ ID NO: 54317 - protein, 229 aa, Homo sapiens [sequence omitted]

SEQ ID NO: 54318 - protein, 131 aa, Homo sapiens [sequence omitted]

SEQ ID NO: 54319 - protein, 179 aa, Homo sapiens
  MOD_RES (1)..(1): Any amino acid
XQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFGQFLEELRNPF

SEQ ID NO: 54320 - protein, 208 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFGQFLEELRNPF

SEQ ID NO: 54321 - protein, 247 aa, Homo sapiens; identical to SEQ ID NO: 54285

SEQ ID NO: 54322 - protein, 131 aa, Homo sapiens [sequence omitted]

SEQ ID NO: 54323 - protein, 213 aa, Homo sapiens; identical to SEQ ID NO: 54278

SEQ ID NO: 54324 - protein, 204 aa, Homo sapiens
SLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFVFHLEALSG

SEQ ID NO: 54325 - protein, 224 aa, Homo sapiens [sequence omitted]

SEQ ID NO: 54326 - protein, 229 aa, Homo sapiens [sequence omitted]

SEQ ID NO: 54327 - protein, 295 aa, Homo sapiens [sequence omitted]

SEQ ID NO: 54328 - protein, 179 aa, Homo sapiens; identical to SEQ ID NO: 54293
  MOD_RES (1)..(1): Any amino acid

SEQ ID NO: 54329 - protein, 213 aa, Homo sapiens; identical to SEQ ID NO: 54278

SEQ ID NO: 54330 - protein, 252 aa, Homo sapiens; identical to SEQ ID NO: 54300

SEQ ID NO: 54331 - protein, 213 aa, Homo sapiens; identical to SEQ ID NO: 54278

SEQ ID NO: 54332 - protein, 224 aa, Homo sapiens [sequence omitted]

SEQ ID NO: 54333 - protein, 204 aa, Homo sapiens; identical to SEQ ID NO: 54295

SEQ ID NO: 54334 - protein, 224 aa, Homo sapiens [sequence omitted]

SEQ ID NO: 54335 - protein, 252 aa, Homo sapiens; identical to SEQ ID NO: 54300

SEQ ID NO: 54336 - protein, 247 aa, Homo sapiens; identical to SEQ ID NO: 54285

SEQ ID NO: 54337 - protein, 204 aa, Homo sapiens; identical to SEQ ID NO: 54295

SEQ ID NO: 54338 - protein, 295 aa, Homo sapiens [sequence omitted]

SEQ ID NO: 54339 - protein, 252 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELLFHLEALSG

SEQ ID NO: 54340 - protein, 179 aa, Homo sapiens; identical to SEQ ID NO: 54293
  MOD_RES (1)..(1): Any amino acid

SEQ ID NO: 54341 - protein, 131 aa, Homo sapiens [sequence omitted]

SEQ ID NO: 54342 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRNPF

SEQ ID NO: 54343 - protein, 213 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFGQFLEELLFHLEALSG

SEQ ID NO: 54344 - protein, 204 aa, Homo sapiens; identical to SEQ ID NO: 54295

SEQ ID NO: 54345 - protein, 229 aa, Homo sapiens [sequence omitted]

SEQ ID NO: 54346 - protein, 204 aa, Homo sapiens; identical to SEQ ID NO: 54295

SEQ ID NO: 54347 - protein, 229 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFESFGVLGPQVKEPKKTGQFLEELLFHLEALSG

SEQ ID NO: 54348 - protein, 229 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFESFGVLGPQVKEPKKTGQFLEELLFHLEALSG

SEQ ID NO: 54349 - protein, 171 aa, Homo sapiens; identical to SEQ ID NO: 54282

SEQ ID NO: 54350 - protein, 177 aa, Homo sapiens [sequence omitted]

SEQ ID NO: 54351 - protein, 57 aa, Homo sapiens
MASLSRPSLPSCLCSFLLLLLLQVSSSYAGLVAVARSWLIAASTSQAQVILLTQPLE

SEQ ID NO: 54352 - protein, 208 aa, Homo sapiens [sequence omitted]

SEQ ID NO: 54353 - protein, 171 aa, Homo sapiens; identical to SEQ ID NO: 54282

SEQ ID NO: 54354 - protein, 171 aa, Homo sapiens; identical to SEQ ID NO: 54282

SEQ ID NO: 54355 - protein, 206 aa, Homo sapiens [sequence omitted]

SEQ ID NO: 54356 - protein, 208 aa, Homo sapiens [sequence omitted]

SEQ ID NO: 54357 - protein, 206 aa, Homo sapiens [sequence omitted]

SEQ ID NO: 54358 - protein, 177 aa, Homo sapiens [sequence omitted]

SEQ ID NO: 54359 - protein, 206 aa, Homo sapiens [sequence omitted]

SEQ ID NO: 54360 - protein, 206 aa, Homo sapiens [sequence omitted]

SEQ ID NO: 54361 - protein, 177 aa, Homo sapiens [sequence omitted]

SEQ ID NO: 54362 - protein, 206 aa, Homo sapiens [sequence omitted]

SEQ ID NO: 54363 - protein, 57 aa, Homo sapiens; identical to SEQ ID NO: 54351

SEQ ID NO: 54364 - protein, 206 aa, Homo sapiens [sequence omitted]

SEQ ID NO: 54365 - protein, 171 aa, Homo sapiens; identical to SEQ ID NO: 54282

SEQ ID NO: 54366 - protein, 206 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFVFHLEALSG

SEQ ID NO: 54367 - protein, 171 aa, Homo sapiens; identical to SEQ ID NO: 54282

SEQ ID NO: 54368 - protein, 171 aa, Homo sapiens; identical to SEQ ID NO: 54282

SEQ ID NO: 54369 - protein, 208 aa, Homo sapiens [sequence omitted]

SEQ ID NO: 54370 - protein, 57 aa, Homo sapiens; identical to SEQ ID NO: 54351

SEQ ID NO: 54371 - protein, 208 aa, Homo sapiens [sequence omitted]

SEQ ID NO: 54372 - protein, 57 aa, Homo sapiens; identical to SEQ ID NO: 54351

SEQ ID NO: 54373 - protein, 177 aa, Homo sapiens [sequence omitted]

SEQ ID NO: 54374 - protein, 171 aa, Homo sapiens; identical to SEQ ID NO: 54282

SEQ ID NO: 54375 - protein, 177 aa, Homo sapiens
MSHISWEERYRNGKDQDGDQAPEYRGRTELLKDAIGEGKVTLRIRNVRFSDEGGFTCFFRDHSYQEEAAMELKVEDPFYWVSPGVLVLLAVLPVLLLQITLGLVFLCLQYRLRGKLRAEIENLHRTFDPHFLRVPCWKITLFVIVPVLGPLVALIICYNWLHRRLAGQFLEELRNPF

SEQ ID NO: 54376 - protein, 208 aa, Homo sapiens [sequence omitted]

SEQ ID NO: 54377 - protein, 57 aa, Homo sapiens; identical to SEQ ID NO: 54351

SEQ ID NO: 54378 - protein, 57 aa, Homo sapiens; identical to SEQ ID NO: 54351

SEQ ID NO: 54379 - protein, 177 aa, Homo sapiens [sequence omitted]

SEQ ID NO: 54380 - protein, 171 aa, Homo sapiens; identical to SEQ ID NO: 54282

SEQ ID NO: 54381 - protein, 177 aa, Homo sapiens [sequence omitted]

SEQ ID NO: 54382 - protein, 57 aa, Homo sapiens; identical to SEQ ID NO: 54351

SEQ ID NO: 54383 - protein, 208 aa, Homo sapiens [sequence omitted]

SEQ ID NO: 54384 - protein, 108 aa, Homo sapiens
MASLSRPSLPSCLCSFLLLLLLQVSSSYADPFYWVSPGVLVLLAVLPVLLLQITVGLIFLCLQYRLRGKLRAEIENLHRTFESFGVLGPQVKEPKKTGQFLEELRNPF

SEQ ID NO: 54385 - protein, 250 aa, Homo sapiens
MAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYQCWTTAEAPKLSVRRRPRGWGSLARIRNSG

SEQ ID NO: 54386 - protein, 258 aa, Homo sapiens
MLRAPAPAPAMAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 54387 - protein, 248 aa, Homo sapiens
MAPGAPSSSPSPILAVLLFSSLVLSPAQAIVVYTDREVHGAVGSRVTLHCSFWSSEWVSDDISFTWRYQPEGGRDAISIFHYAKGQPYIDEVGTFKERIQWVGDPRWKDGSIVIHNLDYSDNGTFTCDVKNPPDIVGKTSQVTLYVFEKVPTRYGVVLGAVIGGVLGVVLLLLLLFYVVRYCWLRRQAALQRRLSAMEKGKLHKPGKDASKRGRQTPVLYAMLDHSRSTKAVSEKKAKGLGESRKDKK

SEQ ID NO: 54388 - protein, 248 aa, Homo sapiens; identical to SEQ ID NO: 54387

SEQ ID NO: 54389 - protein, 215 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 54390 - protein, 215 aa, Homo sapiens; identical to SEQ ID NO: 54389

SEQ ID NO: 54391 - protein, 235 aa, Homo sapiens
MQQRGAAGSRGCALFPLLGVLFFQGVYIVFSLEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 54392 - protein, 223 aa, Homo sapiens
MQQRGAAGSRGCALFPLLGVLFFQDAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 54393 - protein, 1121 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 54394 - protein, 591 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQCFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRRCPTPGCDGSGHITGNYASHRSLSGCPRAKKSGVKVAPTKDDKEDPELMKYVGPCWLFHCIAELRFSCVL

SEQ ID NO: 54395 - protein, 1148 aa, Homo sapiens
MSLENEDKRARTRSKALRGPPETTAADLSCPTPGCTGSGHVRGKYSRHRSLQSCPLAKKRKLEGAEAEHLVSKRKSHPLKLALDEGYGVDSDGSEDTEVKDASVSDESEGTLEGAEAETSGQDEIHRPETAEGRSPVKSHFGSNPIGSATASSKGSYSSYQGIIATSLLNLGQIAEETLVEEDLGQAAKPGPGIVHLLQEAAEGAASEEGEKGLFIQPEDAEEVVEVTTERSQDLCPQSLEDAASEESSKQKGILSHEEEDEEEEEEEEEEEEDEEEEEEEEEEEEEEEEEEEEEEEEEEEEEEEEAAPDVIFQEDTSHTSAQKAPELRGPESPSPKPEYSVIVEVRSDDDKDEDTHSRKSTVTDESEMQDMMTRGNLGLLEQAIALKAEQVRTVCEPGCPPAEQSQLGLGEPGKAAKPLDTVRKSYYSKDPSRAEKREIKCPTPGCDGTGHVTGLYPHHRSLSGCPHKDRIPPEILAMHENVLKCPTPGCTGQGHVNSNRNTHRSLSGCPIAAAEKLAKSHEKQQPQTGDPSKSSSNSDRILRPMCFVKQLEVPPYGSYRPNVAPATPRANLAKELEKFSKVTFDYASFDAQVFGKRMLAPKIQTSETSPKAFQSKPFPKASSPRHSPSSSYVRSTSSSSAGFDYSQDAEAAHMAATAILNLSTRCWEMPENLSTKPQDLPSKSVDIEVDENGTLDLSMHKHRKRENAFPSSSSCSSSPGVKSPDASQRHSSTSAPSSSMTSPQSSQASRQDEWDRPLDYTKPSRLREEEPEESEPAAHSFASSEADDQEVSEENFEERKYPGEVTLTNFKLKFLSKDIKKELLTCPTPGCDGSGHITGNYASHRSLSGCPLADKSLRNLMAAHSADLKCPTPGCDGSGHITGNYASHRSLSGCPRAKKSGVKVAPTKDDKEDPELMKCPVPGCVGLGHISGKYASHRSASGCPLAARRQKEGSLNGSSFSWKSLKNEGPTCPTPGCDGSGHANGSFLTHRSLSGCPRATFAGKKGKLSGDEVLSPKFKTSDVLENDEEIKQLNQEIRDLNESNSEMEAAMVQLQSQISSMEKNLKNIEEENKLIEEQNEALFLELSGLSQALIQSLANIRLPHMEPICEQNFDAYVSTLTDMYSNQDPENKDLLESIKQAVRGIQV

SEQ ID NO: 54396 - protein, 1132 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 54397 - protein, 1186 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYGKDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 54398 - protein, 184 aa, Homo sapiens
MSCPTPGCDGSGHVSGSFLTHRSLSGCPRATSAMKKAKLSGEQMLTIKQRASNGIENDEEIKQLDEEIKELNESNSQMEADMIKLRTQVTITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 54399 - protein, 1184 aa, Homo sapiens
MEVDTEEKRHRTRSKGVRVPVEPAIQELFSCPTPGCDGSGHVSGKYARHRSVYGCPLAKKRKTQDKQPQEPAPKRKPFAVKADSSSVDECDDSDGTEDMDEKEEDEGEEYSEDNDEPGDEDEEDEEGDREEEEEIEEEDEDDDEDGEDVEDEEEEEEEEEEEEEEEENEDHQMNCHNTRIMQDTEKDDNNNDEYDNYDELVAKSLLNLGKIAEDAAYRARTESEMNSNTSNSLEDDSDKNENLGRKSELSLDLDSDVVRETVDSLKLLAQGHGVVLSENMNDRNYADSMSQQDSRNMNYVMLGKPMNNGLMEKMVEESDEEVCLSSLECLRNQCFDLARKLSETNPQERNPQQNMNIRQHVRPEEDFPGRTPDRNYSDMLNLMRLEEQLSPRSRVFASCAKEDGCHERDDDTTSVNSDRSEEVFDMTKGNLTLLEKAIALETERAKAMREKMAMEAGRRDNMRSYEDQSPRQLPGEDRKPKSSDSHVKKPYYDPSRTEKKESKCPTPGCDGTGHVTGLYPHHRSLSGCPHKDRVPPEILAMHESVLKCPTPGCTGRGHVNSNRNSHRSLSGCPIAAAEKLAKAQEKHQSCDVSKSSQASDRVLRPMCFVKQLEIPQYGYRNNVPTTTPRSNLAKELEKYSKTSFEYNSYDNHTYGKRAIAPKVQTRDISPKGYDDAKRYCKDPSPSSSSTSSYAPSSSSNLSCGGGSSASSTCSKSSFDYTHDMEAAHMAATAILNLSTRCREMPQNLSTKPQDLCATRNPDMEVDENGTLDLSMNKQRPRDSCCPILTPLEPMSPQQQAVMNNRCFQLGEGDCWDLPVDYTKMKPRRIDEDESKDITPEDLDPFQEALEERRYPGEVTIPSPKPKYPQCKESKKDLITLSGCPLADKSIRSMLATSSQELKCPTPGCDGSGHITGNYASHRSLSGCPRAKKSGIRIAQSKEDKEDQEPIRCPVPGCDGQGHITGKYASHRSASGCPLAAKRQKDGYLNGSQFSWKSVKTEGMSCPTPGCDGSGHVSGSFLTHRSLSGCPRATSAMKKAKLSGEQMLTIKQRASNGIENDEEIKQLDEEIKELNESNSQMEADMIKLRTQITTMESNLKTIEEENKVIEQQNESLLHELANLSQSLIHSLANIQLPHMDPINEQNFDAYVTTLTEMYTNQDRYQSPENKALLENIKQAVRGIQV

SEQ ID NO: 54400 - protein, 183 aa, Homo sapiens
MSQKPAKEGPRLSKNQKYSEHFSIHCCPPFTFLNSKKEIVDRKYSICKSGCFYQKKEEDWICCACQKTRTSRRAKSPQRPKQQPAAPPAVVRAPAKPRSPPRSERQPRSPPRSERQPRSPPRSERQPRSPPRSERQPRPRPEVRPPPAKQRPPQKSKQQPRSSPLRGPGASRGGSPVKASRFW

SEQ ID NO: 54401 - protein, 81 aa, Homo sapiens
MSQKPAKEGPRLSKNQKYSEHFSIHCCPPFTFLNSKKEIVDRKYSICKSGCFYQKKEEDWICCACQKTRLKRKIRPTPKKK

SEQ ID NO: 54402 - protein, 81 aa, Homo sapiens; identical to SEQ ID NO: 54401

SEQ ID NO: 54403 - protein, 81 aa, Homo sapiens; identical to SEQ ID NO: 54401

SEQ ID NO: 54404 - protein, 183 aa, Homo sapiens; identical to SEQ ID NO: 54400

SEQ ID NO: 54405 - protein, 183 aa, Homo sapiens; identical to SEQ ID NO: 54400

SEQ ID NO: 54406 - protein, 81 aa, Homo sapiens; identical to SEQ ID NO: 54401

SEQ ID NO: 54407 - protein, 183 aa, Homo sapiens; identical to SEQ ID NO: 54400

SEQ ID NO: 54408 - protein, 81 aa, Homo sapiens; identical to SEQ ID NO: 54401

SEQ ID NO: 54409 - protein, 58 aa, Homo sapiens
MSQKPAKEGPRLSKNQKYSEHFSIHCCPPFTFLNSKKEIVDRKYSICKSGCFYQKKEE

SEQ ID NO: 54410 - protein, 140 aa, Homo sapiens
MLQAADFIERTETAGELSRGLIGVLSSQISWCLLNVNLSKLPTRLQRLSCSVLNSSPAMRGGARGRPQLTLERPLRPGCRLHSCSEAEKGGFVRRKEIILFPPCEDPARGWLSANPGREPSPGICWHLNLGLPSLHNCEE

SEQ ID NO: 54411 - protein, 271 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGWVCGVLPCRGPRRWHQECAAGFCRCCWSRSWFGISNKIALL

SEQ ID NO: 54412 - protein, 350 aa, Homo sapiens
MFGLKRNAVIGLNLYCGGAGLGAGSGGATRPGGRLLATEKEASARREIGGGEAGAVIGGSAGASPPSTLTPDSRRVARPPPIGAEVPDVTATPARLLFFAPTRRAAPLEEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 54413 - protein, 279 aa, Homo sapiens
MFGLKRNAVIGLNLYCGGAGLGAGSGGATRPGGRLLATEMEAPAADAIMSPEEELDGYEPEPLGKRPAVLPLLELVGESGNNTSTDGSLPSTPPPAEEEEDELYRQSLEIISRYLREQATGAKDTKPMGRSGATSRKALETLRRVGDGVQRNHETAFQGMLRKLDIKNEDDVKSLSRVMIHVFSDGVTNWGRIVTLISFGAFVAKHLKTINQESCIEPLAESITDVLVRTKRDWLVKQRGWDGFVEFFHVEDLEGGIRNVLLAFAGVAGVGAGLAYLIR

SEQ ID NO: 54414 - protein, 407 aa, Homo sapiens
MVNEYKKILLLKGFELMDDYHFTSIKSLLAYDLGLTTKMQEEYNRIKITDLMEKKFQGVACLDKLIELAKDMPSLKNLVNNLRKEKSKVAKKIKTQEKAPVKKINQEEVGLAAPAPTARNKLTSEARGRIPVAQKRKTPNKEKTEAKRNKVSQEQSKPPGPSGASTSAAVDHPPLPQTSSSTPSNTSFTPNQETQAQRQVDARRNVPQNDPVTVVVLKATAPFKYESPENGKSTMFHATVASKTQYFHVKVFDINLKEKFVRKKVITISDYSECKGVMEIKEASSVSDFNQNFEVPNRIIEIANKTPKISQLYKQASGTMVYGLFMLQKKSVHKKNTIYEIQDNTGSMDVVGSGKWHNIKCEKGDKLRLFCLQLRTVDRKLKLVCGSHSFIKVIKAKKNKEGPMNVN

SEQ ID NO: 54415 - protein, 104 aa, Homo sapiens
  MOD_RES (1)..(1): Any amino acid
XPNRIIEIANKTPKISQLYKQASGTMVYGLFMLQKKSVHKKNTIYEIQDNTGSMDVVGSGKWHNIKCEKGDKLRLFCLQLRTVDRKLKLVIKAKKNKEGPMNVN

SEQ ID NO: 54416 - protein, 264 aa, Homo sapiens
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIGHMPERFDAFICYCPSDIQFVQEMIRQLEQTNYRLKLCVSDRDVLPGTCVWSIASELIEKRCRRMVVVVSDDYLQSKECDFQTKFALSLSPGAHQKRLIPIKYKAMKKEFPSILRFITVCDYTNPCTKSWFWTRLAKALSLP

SEQ ID NO: 54417 - protein, 204 aa, Homo sapiens
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIEEDCQKYILKQQQEEAEKPLQVAAVDSSVPRTAELAGITTLDDPLGAAGWWWLSLMITCRARNVTSRPNLHSASLQVPIRSD

SEQ ID NO: 54418 - protein, 159 aa, Homo sapiens
MRPDRAEAPGPPAMAAGGPGAGSAAPVSSTSSLPLAALNMRVRRRLSLFLNVRTQVAADWTALAEEMDFEYLEIRQLETQADPTGRLLDAWQGRPGASVGRLLELLTKLGRDDVLLELGPSIGAAGWWWLSLMITCRARNVTSRPNLHSASLQVPIRSD

SEQ ID NO: 54419 - protein, 268 aa, Homo sapiens
MFRMLNSSFEDDPFFSESILAHRENMRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54420 - protein, 243 aa, Homo sapiens
MRQMIRSFSEPFGRDLLSISDGRGRAHNRRGHNDGEDSLTHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54421 - protein, 299 aa, Homo sapiens
MLKEVLQREGKSYKSETLMYIKKARASENKLSESILAHRENMRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54422 - protein, 258 aa, Homo sapiens
MRQMIRSFSEPFGRDLLSISDGRGRAHNRRGHNDGEDSLTATSCSLVPFGDFGGMHTDVSSFQTMDQMVSNMRNYMQKLERNFGQLSVDPNGHSFCSSSVMTYSKIGDEPPKVFQASTQTRRAPGGIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54423 - protein, 258 aa, Homo sapiens; identical to SEQ ID NO: 54422

SEQ ID NO: 54424 - protein, 243 aa, Homo sapiens; identical to SEQ ID NO: 54420

SEQ ID NO: 54425 - protein, 243 aa, Homo sapiens; identical to SEQ ID NO: 54420

SEQ ID NO: 54426 - protein, 200 aa, Homo sapiens
MRQMIRSFSEPFGRDLLSISDGRGRAHNRRGHNDGEDSLTHTDVSSFQTMDQMVSNMRNYMQKLERNFIKETRKAMRDSDSGLEKMAIGHHIHDRAHVIKKSKNKKTGDEEVNQEFINMNESDAHAFDEEWQSEVLKYKPGRHNLGNTRMRSVGHENPGSRELKRREKPQQSPAIEHGRRSNVLGDKLHIKGSSVKSNKK

SEQ ID NO: 54427 - protein, 248 aa, Homo sapiens
MFRFMRDVEPEDPMFLMDPFAIHRQHMSRMLSGGFGYSPFLSITDGNMPGTRPASRRMQQAGAVSPFGMLGMSGGFMDMFGMMNDMIGNMEHMTAGGNCQTFSSSTVISYSNTGDGAPKVYQETSEMRSAPGGIRETRRTVRDSDSGLEQMSIGHHIRDRAHILQRSRNHRTGDQEERQDYINLDESEAAAFDDEWRRETSRFRQQRPLEFRRLESSGAGGRRAEGPPRLAIQGPEDSPSRQSRRYDW

SEQ ID NO: 54428 - protein, 248 aa, Homo sapiens; identical to SEQ ID NO: 54427

SEQ ID NO: 54429 - protein, 248 aa, Homo sapiens; identical to SEQ ID NO: 54427

SEQ ID NO: 54430 - protein, 248 aa, Homo sapiens; identical to SEQ ID NO: 54427

SEQ ID NO: 54431 - protein, 734 aa, Homo sapiens
MRPAVLGSPDRAPPEDEGPVMVKLEDSEEEGEAALWDPGPEAARLRFRCFRYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGFALQLGSISAGPGSVSPHLHVPWDLGMAGLSGQIQSPSREGGFAHALLLPSDLRSEQDPTDEDPCRGVGPALITTRWRSPRGRSRGRPSTGGGVVRGGRCDVCGKVFSQRSNLLRHQKIHTGERPFVCSECGRSFSRSSHLLRHQLTHTEERPFVCGDCGQGFVRSARLEEHRRVHTGEQPFRCAECGQSFRQRSNLLQHQRIHGDPPGPGAKPPAPPGAPEPPGPFPCSECRESFARRAVLLEHQAVHTGDKSFGCVECGERFGRRSVLLQHRRVHSGERPFACAECGQSFRQRSNLTQHRRIHTGERPFACAECGKAFRQRPTLTQHLRVHTGEKPFACPECGQRFSQRLKLTRHQRTHTGEKPYHCGECGLGFTQVSRLTEHQRIHTGERPFACPECGQSFRQHANLTQHRRIHTGERPYACPECGKAFRQRPTLTQHLRTHRREKPFACQDCGRRFHQSTKLIQHQRVHSAE

SEQ ID NO: 54432 - protein, 290 aa, Homo sapiens
MRPAVLGSPDRAPPEDEGPVMVKLEDSEEEGEAALWDPGPEAARLRFRCFRYEEATGPQEALAQLRELCRQWLRPEVRSKEQMLELLVLEQFLGALPPEIQARVQGQRPGSPEEAAALVDGLRREPGGPRRWVTVQVQGQEVLSEKMEPSSFQPLPETEPPTPEPGPKTPPRTMQESPLGLQVKEESEVTEDSDFLESGPLAATQESVPTLLPEEAQRCGTVLDQIFPHSKTGPEGPSWREHPRALWHEEAGGIFSPGAGAGAAPALGAGWLGAAVAMYVARCSANAATC

SEQ ID NO: 54433 - protein, 734 aa, Homo sapiens; identical to SEQ ID NO: 54431

SEQ ID NO: 54434 - protein, 512 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGELTTQIPCSWRTKGHIHDKKTEPFRLLAWSWCLNDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRS

SEQ ID NO: 54435 - protein, 3931 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 54436 - protein, 2879 aa, Homo sapiens
HAHPECLTMEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 54437 - protein, 3969 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 54438 - protein, 111 aa, Homo sapiens
DFKDEQFLGFGSDEEVRVRSPTRSPSGSMLAQADKLPMTDKRVASLLKKAKAQLCKIEKSKSLKQTDQPKAQGQESDSSETSVRGPRIKHVCRRAAVALGRKRAVFPDDMP

SEQ ID NO: 54439 - protein, 1439 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGELTTQIPCSWRTKGHIHDKKTEPFRLLAWSWCLNDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFK

SEQ ID NO: 54440 - protein, 3972 aa, Homo sapiens
MAHSCRWRFPARPGTTGGGGGGGRRGLGGAPRQRVPALLLPPGPPVGGGGPGAPPSPPAVAAAAAAAGSSGAGVPGGAAAASAASSSSASSSSSSSSSASSGPALLRVGPGFDAALQVSAAIGTNLRRFRAVFGESGGGGGSGEDEQFLGFGSDEEVRVRSPTRSPSVKTSPRKPRGRPRSGSDRNSAILSDPSVFSPLNKSETKSGDKIKKKDSKSIEKKRGRPPTFPGVKIKITHGKDISELPKGNKEDSLKKIKRTPSATFQQATKIKKLRAGKLSPLKSKFKTGKLQIGRKGVQIVRRRGRPPSTERIKTPSGLLINSELEKPQKVRKDKEGTPPLTKEDKTVVRQSPRRIKPVRIIPSSKRTDATIAKQLLQRAKKGAQKKIEKEAAQLQGRKVKTQVKNIRQFIMPVVSAISSRIIKTPRRFIEDEDYDPPIKIARLESTPNSRFSAPSCGSSEKSSAASQHSSQMSSDSSRSSSPSVDTSTDSQASEEIQVLPEERSDTPEVHPPLPISQSPENESNDRRSRRYSVSERSFGSRTTKKLSTLQSAPQQQTSSSPPPPLLTPPPPLQPASSISDHTPWLMPPTIPLASPFLPASTAPMQGKRKSILREPTFRWTSLKHSRSEPQYFSSAKYAKEGLIRKPIFDNFRPPPLTPEDVGFASGFSASGTAASARLFSPLHSGTRFDMHKRSPLLRAPRFTPSEAHSRIFESVTLPSNRTSAGTSSSGVSNRKRKRKVFSPIRSEPRSPSHSMRTRSGRLSSSELSPLTPPSSVSSSLSISVSPLATSALNPTFTFPSHSLTQSGESAEKNQRPRKQTSAPAEPFSSSSPTPLFPWFTPGSQTERGRNKDKAPEELSKDRDADKSVEKDKSRERDREREKENKRESRKEKRKKGSEIQSSSALYPVGRVSKEKVVGEDVATSSSAKKATGRKKSSSHDSGTDITSVTLGDTTAVKTKILIKKGRGNLEKTNLDLGPTAPSLEKEKTLCLSTPSSSTVKHSTSSIGSMLAQADKLPMTDKRVASLLKKAKAQLCKIEKSKSLKQTDQPKAQGQESDSSETSVRGPRIKHVCRRAAVALGRKRAVFPDDMPTLSALPWEEREKILSSMGNDDKSSIAGSEDAEPLAPPIKPIKPVTRNKAPQEPPVKKGRRSRRCGQCPGCQVPEDCGVCTNCLDKPKFGGRNIKKQCCKMRKCQNLQWMPSKAYLQKQAKAVKKKEKKSKTSEKKDSKESSVVKNVVDSSQKPTPSAREDPAPKKSSSEPPPRKPVEEKSEEGNVSAPGPESKQATTPASRKSSKQVSQPALVIPPQPPTTGPPRKEVPKTTPSEPKKKQPPPPESGPEQSKQKKVAPRPSIPVKQKPKEKEKPPPVNKQENAGTLNILSTLSNGNSSKQKIPADGVHRIRVDFKEDCEAENVWEMGGLGILTSVPITPRVVCFLCASSGHVEFVYCQVCCEPFHKFCLEENERPLEDQLENWCCRRCKFCHVCGRQHQATKQLLECNKCRNSYHPECLGPNYPTKPTKKKKVWICTKCVRCKSCGSTTPGKGWDAQWSHDFSLCHDCAKLFAKGNFCPLCDKCYDDDDYESKMMQCGKCDRWVHSKCENLSGTEDEMYEILSNLPESVAYTCVNCTERHPAEWRLALEKELQISLKQVLTALLNSRTTSHLLRYRQAAKPPDLNPETEESIPSRSSPEGPDPPVLTEVSKQDDQQPLDLEGVKRKMDQGNYTSVLEFSDDIVKIIQAAINSDGGQPEIKKANSMVKSFFIRQMERVFPWFSVKKSRFWEPNKVSSNSGMLPNAVLPPSLDHNYAQWQEREENSHTEQPPLMKKIIPAPKPKGPGEPDSPTPLHPPTPPILSTDRSREDSPELNPPPGIEDNRQCALCLTYGDDSANDAGRLLYIGQNEWTHVNCALWSAEVFEDDDGSLKNVHMAVIRGKQLRCEFCQKPGATVGCCLTSCTSNYHFMCSRAKNCVFLDDKKVYCQRHRDLIKGEVVPENGFEVFRRVFVDFEGISLRRKFLNGLEPENIHMMIGSMTIDCLGILNDLSDCEDKLFPIGYQCSRVYWSTTDARKRCVYTCKIVECRPPVVEPDINSTVEHDENRTIAHSPTSFTESSSKESQNTAEIISPPSPDRPPHSQTSGSCYYHVISKVPRIRTPSYSPTQRSPGCRPLPSAGSPTPTTHEIVTVGDPLLSSGLRSIGSRRHSTSSLSPQRSKLRIMSPMRTGNTYSRNNVSSVSTTGTATDLESSAKVVDHVLGPLNSSTSLGQNTSTSSNLQRTVVTVGNKNSHLDGSSSSEMKQSSASDLVSKSSSLKGEKTKVLSSKSSEGSAHNVAYPGIPKLAPQVHNTTSRELNVSKIGSFAEPSSVSFSSKEALSFPHLHLRGQRNDRDQHTDSTQSANSSPDEDTEVKTLKLSGMSNRSSIINEHMGSSSRDRRQKGKKSCKETFKEKHSSKSFLEPGQVTTGEEGNLKPEFMDEVLTPEYMGQRPCNNVSSDKIGDKGLSMPGVPKAPPMQVEGSAKELQAPRKRTVKVTLTPLKMENESQSKNALKESSPASPLQIESTSPTEPISASENPGDGPVAQPSPNNTSCQDSQSNNYQNLPVQDRNLMLPDGPKPQEDGSFKRRYPRRSARARSNMFFGLTPLYGVRSYGEEDIPFYSSSTGKKRGKRSAEGQVDGADDLSTSDEDDLYYYNFTRTVISSGGEERLASHNLFREEEQCDLPKISQLDGVDDGTESDTSVTATTRKSSQIPKRNGKENGTENLKIDRPEDAGEKEHVTKSSVGHKNEPKMDNCHSVSRVKTQGQDSLEAQLSSLESSRRVHTSTPSDKNLLDTYNTELLKSDSDNNNSDDCGNILPSDIMDFVLKNTPSMQALGESPESSSSELLNLGEGLGLDSNREKDMGLFEVFSQQLPTTEPVDSSVSSSISAEEQFELPLELPSDLSVLTTRSPTVPSQNPSRLAVISDSGEKRVTITEKSVASSESDPALLSPGVDPTPEGHMTPDHFIQGHMDADHISSPPCGSVEQGHGNNQDLTRNSSTPGLQVPVSPTVPIQNQKYVPNSTDSPGPSQISNAAVQTTPPHLKPATEKLIVVNQNMQPLYVLQTLPNGVTQKIQLTSSVSSTPSVMETNTSVLGPMGGGLTLTTGLNPSLPTSQSLFPSASKGLLPMSHHQHLHSFPAATQSSFPPNISNPPSGLLIGVQPPPDPQLLVSESSQRTDLSTTVATPSSGLKKRPISRLQTRKNKKLAPSSTPSNIAPSDVVSNMTLINFTPSQLPNHPSLLDLGSLNTSSHRTVPNIIKRSKSSIMYFEPAPLLPQSVGGTAATAAGTSTISQDTSHLTSGSVSGLASSSSVLNVVSMQTTTTPTSSASVPGHVTLTNPRLLGTPDIGSISNLLIKASQQSLGIQDQPVALPPSSGMFPQLGTSQTPSTAAITAASSICVLPSTQTTGITAASPSGEADEHYQLQHVNQLLASKTGIHSSQRDLDSASGPQVSNFTQTVDAPNSMGLEQNKALSSAVQASPTSPGGSPSSPSSGQRSASPSVPGPTKPKPKTKRFQLPLDKGNGKKHKVSHLRTSSSEAHIPDQETTSLTSGTGTPGAEAEQQDTASVEQSSQKECGQPAGQVAVLPEVQVTQNPANEQESAEPKTVEEEESNFSSPLMLWLQQEQKRKESITEKKPKKGLVFEISSDDGFQICAESIEDAWKSLTDKVQEARSNARLKQLSFAGVNGLRMLGILHDAVVFLIEQLSGAKHCRNYKFRFHKPEEANEPPLNPHGSARAEVHLRKSAFDMFNFLASKHRQPPEYNPNDEEEEEVQLKSARRATSMDLPMPMRFRHLKKTSKEAVGVYRSPIHGRGLFCKRNIDAGEMVIEYAGNVIRSIQTDKREKYYDSKGIGCYMFRIDDSEVVDATMHGNAARFINHSCEPNCYSRVINIDGQKHIVIFAMRKIYRGEELTYDYKFPIEDASNKLPCNCGAKKCRKFLN

SEQ ID NO: 54441 - protein, 559 aa, Homo sapiens
MDNQCTVQVRLELGHRAQLRKKPTTEGFTHDWMVFVRGPEQCDIQHFVEKVVFWLHDSFPKPRRVCKEPPYKVEESGYAGFIMPIEVHFKNKEEPRKVCFTYDLFLNLEGNPPVNHLRCEKLTFNNPTTEFRYKLLRAGGVMVMPEGADTVSRPSPDYPMLPTIPLSAFSDPKKTKPSHGSKDANKESSKTSKPHKVTKEHRERPRKDSESKSSSKELEREQAKSSKDTSRKLGEGRLPKEEKAPPPKAAFKEPKMALKETKLESTSPKGGPPPPPPPPPRASSKRPATADSPKPSAKKQKKSSSKGSRSAPGTSPRTSSSSSFSDKKPAKDKSSTRGEKVKAESEPREAKKALEVEESNSEDEASFKSESAQSSPSNSSSSSDSSSDSDFEPSQNHSQGPLRSMVEDLQSEESDEDDSSSGEEAAGKTNPGRDSRLSFSDSESDNSADSSLPSREPPPPQKPPPPNSKVSGRRSPESCSKPEKILKKGTYDKAYTDELVELHRRLMALRERNVLQQIVNLIEETGHFNVTNTTFDFDLFSLDETTVRKLQSCLEAVAT

SEQ ID NO: 54442 - protein, 90 aa, Homo sapiens
MRDPVSSQYSSFLFWRMPIPELDLSELEGLGLSDTATYKVKDSSVGKMIGQATAADQEKNPEGDGLLEYSTFNFWRAPIASIHSFELDLL

SEQ ID NO: 54443 - protein, 138 aa, Homo sapiens
MKDLHSDDNEEESDEVEDNDNDSEMERPVNRGGSRSRRVSLSDGSDSESSSASSPLHHEPPPPLLKTNNNQILEVKSPIKQSKSDKQIKNGECDKIVNLIEETGHFHITNTTFDFDLCSLDKTTVRKLQSYLETSGTS

SEQ ID NO: 54444 - protein, 162 aa, Homo sapiens
MKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 54445 - protein, 138 aa, Homo sapiens; identical to SEQ ID NO: 54443

SEQ ID NO: 54446 - protein, 568 aa, Homo sapiens
MASSCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 54447 - protein, 565 aa, Homo sapiens
MCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 54448 - protein, 607 aa, Homo sapiens
MQRAPPFPFMCVSRRRKKCQAQRSLPKPRLPVIHGCLSSPCPQCAVQVKLELGHRAQVRKKPTVEGFTHDWMVFVRGPEHSNIQHFVEKVVFHLHESFPRPKRVCKDPPYKVEESGYAGFILPIEVYFKNKEEPRKVRFDYDLFLHLEGHPPVNHLRCEKLTFNNPTEDFRRKLLKAGGDPNRSIHTSSSSSSSSSSSSSSSSSSSSSSSSSSSSSSSSSSSSSSSSSSTSFSKPHKLMKEHKEKPSKDSREHKSAFKEPSRDHNKSSKESSKKPKENKPLKEEKIVPKMAFKEPKPMSKEPKPDSNLLTITSGQDKKAPSKRPPISDSEELSAKKRKKSSSEALFKSFSSAPPLILTCSADKKQIKDKSHVKMGKVKIESETSEKKKSTLPPFDDIVDPNDSDVEENISSKSDSEQPSPASSSSSSSSSFTPSQTRQQGPLRSIMKDLHSDDNEEESDEVEDNDNDSEMERPVNRGGSRSRRVSLSDGSDSESSSASSPLHHEPPPPLLKTNNNQILEVKSPIKQSKSDKQIKNGECDKAYLDELVELHRRLMTLRERHILQQIVNLIEETGHFHITNTTFDFDLCSLDKTTVRKLQSYLETSGTS

SEQ ID NO: 54449 - protein, 1661 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAIPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARQTAMPAISVLDLLQDEERRRQQQLEEMRKREAEDRARQEEERRRQEEERTKRDAEEK

SEQ ID NO: 54450 - protein, 1665 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARQTAMPAISVLDLLQDEERRRQQQLEEMRKREAEDRARQEEERRRQEEERTKRDAEEKVMVL

SEQ ID NO: 54451 - protein, 1824 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAIPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 54452 - protein, 1651 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARDEERRRQQQLEEMRKREAEDRARQEEERRRQEEERTKRDAEEKVMVL

SEQ ID NO: 54453 - protein, 1743 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAIPLRKEPEIITVTLKKQNGMGLSIVAAKGAGQDKLGIYVKSVVKGGAADDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGPNSYPGSTGAAVGAHDACRDAKEKRSKSQDADSPGSSGAPENLTFKERQRLFSQGQDVSNKVKASRKLTELENELNTK

SEQ ID NO: 54454 - protein, 1824 aa, Homo sapiens
MSAGGRDEERRKLADIIHHWNANRLDLFEISQPTEDLEFHGVMRFYFQDKAAGNFATKCIRVSSTATTQDVIETLAEKFRPDMRMLSSPKYSLYEVHVSGERRLDIDEKPLVVQLNWNKDDREGRFVLKNENDAIPPKKAQSNGPEKQEKEGVIQNFKRTLSKKEKKEKKKREKEALRQASDKDDRPFQGEDVENSRLAAEVYKDMPETSFTRTISNPEVVMKRRRQQKLEKRMQEFRSSDGRPDSGGTLRIYADSLKPNIPYKTILLSTTDPADFAVAEALEKYGLEKENPKDYCIARVMLPPGAQHSDEKGAKEIILDDDECPLQIFREWPSDKGILVFQLKRRPPDHIPKKTKKHLEGKTPKGKERADGSGYGSTLPPEKLPYLVELSPGRRNHFAYYNYHTYEDGSDSRDKPKLYRLQLSVTEVGTEKLDDNSIQLFGPGIQPHHCDLTNMDGVVTVTPRSMDAETYVEGQRISETTMLQSGMKVQFGASHVFKFVDPSQDHALAKRSVDGGLMVKGPRHKPGIVQETTFDLGGDIHSGTALPTSKSTTRLDSDRVSSASSTAERGMVKPMIRVEQQPDYRRQESRTQDASGPELILPASIEFRESSEDSFLSAIINYTNSSTVHFKLSPTYVLYMACRYVLSNQYRPDISPTERTHKVIAVVNKMVSMMEGVIQKQKNIAGALAFWMANASELLNFIKQDRDLSRITLDAQDVLAHLVQMAFKYLVHCLQSELNNYMPAFLDDPEENSLQRPKIDDVLHTLTGAMSLLRRCRVNAALTIQLFSQLFHFINMWLFNRLVTDPDSGLCSHYWGAIIRQQLGHIEAWAEKQGLELAADCHLSRIVQATTLLTMDKYAPDDIPNINSTCFKLNSLQLQALLQNYHCAPDEPFIPTDLIENVVTVAENTADELARSDGREVQLEEDPDLQLPFLLPEDGYSCDVVRNIPNGLQEFLDPLCQRGFCRLIPHTRSPGTWTIYFEGADYESHLLRENTELAQPLRKEPEIITVTLKKQNGMGLSIVAAKGAGQDKLGIYVKSVVKGGAADVDGRLAAGDQLLSVDGRSLVGLSQERAAELMTRTSSVVTLEVAKQGAIYHGLATLLNQPSPMMQRISDRRGSGKPRPKSEGFELYNNSTQNGSPESPQLPWAEYSEPKKLPGDDRLMKNRADHRSSPNVANQPPSPGGKSAYASGTTAKITSVSTGNLCTEEQTPPPRPEAYPIPTQTYTREYFTFPASKSQDRMAPPQNQWPNYEEKPHMHTDSNHSSIAIQRVTRSQEELREDKAYQLERHRIEAAMDRKSDSDMWINQSSSLDSSTSSQEHLNHSSKSVTPASTLTKSGPGRWKTPAAIPATPVAVSQPIRTDLPPPPPPPPVHYAGDFDGMSMDLPLPPPPSANQIGLPSAQVAAAERRKREEHQRWYEKEKARLEEERERKRREQERKLGQMRTQSLNPAPFSPLTAQQMKPEKPSTLQRPQETVIRELQPQQQPRTIERRDLQYITVSKEELSSGDSLSPDPWKRDAKEKLEKQQQMHIVDMLSKEIQELQSKPDRSAEESDRLRKLMLEWQFQKRLQESKQKDEDDEEEEDDDVDTMLIMQRLEAERRARLQDEERRRQQQLEEMRKREAEDRARQEEERRRQEEERTKRDAEEKRRQEEGYYSRLEAERRRQHDEAARRLLEPEAPGLCRPPLPRDYEPPSPSPAPGAPPPPPQRNASYLKTQVLSPDSLFTAKFVAYNEEEEEEDCSLAGPNSYPGSTGAAVGAHDACRDAKEKRSKSQDADSPGSSGAPENLTFKERQRLFSQGQDVSNKVKASRKLTELENELNTK

SEQ ID NO: 54455 - protein, 1093 aa, Homo sapiens [sequence omitted]

SEQ ID NO: 54456 - protein, 325 aa, Homo sapiens
MKEMVGGCCVCSDERGWAENPLVYCDGHACSVVVHQACYGIVQVPTGPWFCRKCESQERAARVRCELCPHKDGALKRTDNGGWAHVVCALYIPEVQFANVLTMEPIVLQYVPHDRFNKTCYICEEQGRESKAASGACMTCNRHGCRQAFHVTCAQMAGLLCEEEVLEVDNVKYCGYCKYHFSKMKTSRHSSGGGGGGAGGGGGSMGGGGSGFISGRRSRSASPSTQQEKHPTHHERGQKKSRKDKERLKQKHKKRPESPPSILTPPVVPTADKPRRGHQSPTNHGIGSLGCCLPDTPICLCPEGLSPGLLSAESGGRHSGLLSKF

SEQ ID NO: 54457 - protein, 5537 aa, Homo sapiens
MDSQKLAGEDKDSEPAADGPAASEDPSATESDLPNPHVGEVSVLSSGSPRLQETPQDCSGGPVRRCALCNCGEPSLHGQRELRRFELPFDWPRCPVVSPGGSPGPNEAVLPSEDLSQIGFPEGLTPAHLGEPGGSCWAHHWCAAWSAGVWGQEGPELCGVDKAIFSGISQRCSHCTRLGASIPCRSPGCPRLYHFPCATASGSFLSMKTLQLLCPEHSEGAAYLEEARCAVCEGPGELCDLFFCTSCGHHYHGACLDTALTARKRAGWQCPECKVCQACRKPGNDSKMLVCETCDKGYHTFCLKPPMEELPAHSWKCKACRVCRACGAGSAELNPNSEWFENYSLCHRCHKAQGGQTIRSVAEQHTPVCSRFSPPEPGDTPTDEPDALYVACQGQPKGGHVTSMQPKEPGPLQCEAKPLGKAGVQLEPQLEAPLNEEMPLLPPPEESPLSPPPEESPTSPPPEASRLSPPPEELPASPLPEALHLSRPLEESPLSPPPEESPLSPPPESSPFSPLEESPLSPPEESPPSPALETPLSPPPEASPLSPPFEESPLSPPPEELPTSPPPEASRLSPPPEESPMSPPPEESPMSPPPEASRLFPPFEESPLSPPPEESPLSPPPEASRLSPPPEDSPMSPPPEESPMSPPPEVSRLSPLPVVSRLSPPPEESPLSPPPEESPTSPPPEASRLSPPPEDSPTSPPPEDSPASPPPEDSLMSLPLEESPLLPLPEEPQLCPRSEGPHLSPRPEEPHLSPRPEEPHLSPQAEEPHLSPQPEEPCLCAVPEEPHLSPQAEGPHLSPQPEELHLSPQTEEPHLSPVPEEPCLSPQPEESHLSPQSEEPCLSPRPEESHLSPELEKPPLSPRPEKPPEEPGQCPAPEELPLFPPPGEPSLSPLLGEPALSEPGEPPLSPLPEELPLSPSGEPSLSPQLMPPDPLPPPLSPIITAAAPPALSPLGELEYPFGAKGDSDPESPLAAPILETPISPPPEANCTDPEPVPPMILPPSPGSPVGPASPILMEPLPPQCSPLLQHSLVPQNSPPSQCSPPALPLSVPSPLSPIGKVVGVSDEAELHEMETEKVSEPECPALEPSATSPLPSPMGDLSCPAPSPAPALDDFSGLGEDTAPLDGIDAPGSQPEPGQTPGSLASELKGSPVLLDPEELAPVTPMEVYPECKQTAGQGSPCEEQEEPRAPVAPTPPTLIKSDIVNEISNLSQGDASASFPGSEPLLGSPDPEGGGSLSMELGVSTDVSPARDEGSLRLCTDSLPETDDSLLCDAGTAISGGKAEGEKGRRRSSPARSRIKQGRSSSFPGRRRPRGGAHGGRGRGRARLKSTASSIETLVVADIDSSPSKEEEEEDDDTMQNTVVLFSNTDKFVLMQDMCVVCGSFGRGAEGHLLACSQCSQCYHPYCVNSKITKVMLLKGWRCVECIVCEVCGQASDPSRLLLCDDCDISYHTYCLDPPLLTVPKGGWKCKWCVSCMQCGAASPGFHCEWQNSYTHCGPCASLVTCPICHAPYVEEDLLIQCRHCERWMHAGCESLFTEDDVEQAADEGFDCVSCQPYVVKPVAPVAPPELVPMKVKEPEPQYFRFEGVWLTETGMALLRNLTMSPLHKRRQRRGRLGLPGEAGLEGSEPSDALGPDDKKDGDLDTDELLKGEGGVEHMECEIKLEGPVSPDVEPGKEETEESKKRKRKPYRPGIGGFMVRQRKSHTRTKKGPAAQAEVLSGDGQPDEVIPADLPAEGAVEQSLAEGDEKKKQQRRGRKKSKLEDMFPAYLQEAFFGKELLDLSRKALFAVGVGRPSFGLGTPKAKGDGGSERKELPTSQKGDDGPDIADEESRGLEGKADTPGPEDGGVKASPVPSDPEKPGTPGEGMLSSDLDRISTEELPKMESKDLQQLFKDVLGSEREQHLGCGTPGLEGSRTPLQRPFLQGGLPLGNLPSSSPMDSYPGLCQSPFLDSRERGGFFSPEPGEPDSPWTGSGGTTPSTPTTPTTEGEGDGLSYNQRSLQRWEKDEELGQLSTISPVLYANINFPNLKQDYPDWSSRCKQIMKLWRKVPAADKAPYLQKAKDNRAAHRINKVQKQAESQINKQTKVGDIARKTDRPALHLRIPPQPGALGSPPPAAAPTIFIGSPTTPAGLSTSADGFLKPPAGSVPGPDSPGELFLKLPPQVPAQVPSQDPFGLAPAYPLEPRFPTAPPTYPPYPSPTGAPAQPPMLGASSRPGAGQPGEFHTTPPGTPRHQPSTPDPFLKPRCPSLDNLAVPESPGVGGGKASEPLLSPPPFGESRKALEVKKEELGASSPSYGPPNLGFVDSPSSGTHLGGLELKTPDVFKAPLTPRASQVEPQSPGLGLRPQEPPPAQALAPSPPSHPDIFRPGSYTDPYAQPPLTPRPQPPPPESCCALPPRSLPSDPFSRVPASPQSQSSSQSPLTPRPLSAEAFCPSPVTPRFQSPDPYSRPPSRPQSRDPFAPLHKPPRPQPPEVAFKAGSLAHTSLGAGGFPAALPAGPAGELHAKVPSGQPPNFVRSPGTGAFVGTPSPMRFTFPQAVGEPSLKPPVPQPGLPPPHGINSHFGPGPTLGKPQSTNYTVATGNFHPSGSPLGPSSGSTGESYGLSPLRPPSVLPPPAPDGSLPYLSHGASQRSGITSPVEKREDPGTGMGSSLATAELPGTQDPGMSGLSQTELEKQRQRQRLRELLIRQQIQRNTLRQEKETAAAAAGAVGPPGSWGAEPSSPAFEQLSRGQTPFAGTQDKSSLVGLPPSKLSGPILGPGSFPSDDRLSRPPPPATPSSMDVNSRQLVGGSQAFYQRAPYPGSLPLQQQQQQLWQQQQATAATSMRFAMSARFPSTPGPELGRQALGSPLAGISTRLPGPGEPVPGPAGPAQFIELRHNVQKGLGPGGTPFPGQGPPQRPRFYPVSEDPHRLAPEGLRGLAVSGLPPQKPSAPPAPELNNSLHPTPHTKGPTLPTGLELVNRPPSSTELGRPNPLALEAGKLPCEDPELDDDFDAHKALEDDEELAHLGLGVDVAKGDDELGTLENLETNDPHLDDLLNGDEFDLLAYTDPELDTGDKKDIFNEHLRLVESANEKAEREALLRGVEPGPLGPEERPPPAADASEPRLASVLPEVKPKVEEGGRHPSPCQFTIATPKVEPAPAANSLGLGLKPGQSMMGSRDTRMGTGPFSSSGHTAEKASFGATGGPPAHLLTPSPLSGPGGSSLLEKFELESGALTLPGGPAASGDELDKMESSLVASELPLLIEDLLEHEKKELQKKQQLSAQLQPAQQQQQQQQQHSLLSAPGPAQAMSLPHEGSSPSLAGSQQQLSLGLAGARQPGLPQPLMPTQPPAHALQQRLAPSMAMVSNQGHMLSGQHGGQAGLVPQQSSQPVLSQKPMGTMPPSMCMKPQQLAMQQQLANSFFPDTDLDKFAAEDIIDPIAKAKMVALKGIKKVMAQGSIGVAPGMNRQQVSLLAQRLSGGPSSDLQNHVAAGSGQERSAGDPSQPRPNPPTFAQGVINEADQRQYEEWLFHTQQLLQMQLKVLEEQIGVHRKSRKALCAKQRTAKKAGREFPEADAEKLKLVTEQQSKIQKQLDQVRKQQKEHTNLMAEYRNKQQQQQQQQQQQQQQHSAVLALSPSQSPRLLTKLPGQLLPGHGLQPPQGPPGGQAGGLRLTPGGMALPGQPGGPFLNTALAQQQQQQHSGGAGSLAGPSGGFFPGNLALRSLGPDSRLLQERQLQLQQQRMQLAQKLQQQQQQQQQQQHLLGQVAIQQQQQQGPGVQTNQALGPKPQGLMPPSSHQGLLVQQLSPQPPQGPQGMLGPAQVAVLQQQHPGALGPQGPHRQVLMTQSRVLSSPQLAQQGQGLMGHRLVTAQQQQQQQQHQQQGSMAGLSHLQQSLMSHSGQPKLSAQPMGSLQQLQQQQQLQQQQQLQQQQQQQLQQQQQLQQQQLQQQQQQQQLQQQQQQQLQQQQQQLQQQQQQQQQQFQQQQQQQQMGLLNQSRTLLSPQQQQQQQVALGPGMPAKPLQHFSSPGALGPTLLLTGKEQNTVDPAVSSEATEGPSTHQGGPLAIGTTPESMATEPGEVKPSLSGDSQLLLVQPQPQPQPSSLQLQPPLRLPGQQQQQVSLLHTAGGGSHGQLGSGSSSEASSVPHLLAQPSVSLGDQPGSMTQNLLGPQQPMLERPMQNNTGPQPPKPGPVLQSGQGLPGVGIMPTVGQLRAQLQGVLAKNPQLRHLSPQQQQQLQALLMQRQLQQSQAVRQTPPYQEPGTQTSPLQGLLGCQPQLGGFPGPQTGPLQELGAGPRPQGPPRLPAPPGALSTGPVLGPVHPTPPPSSPQEPKRPSQLPSPSSQLPTEAQLPPTHPGTPKPQGPTLEPPPGRVSPAAAQLADTLFSKGLGPWDPPDNLAETQKPEQSSLVPGHLDQVNGQVVPEASQLSIKQEPREEPCALGAQSVKREANGEPIGAPGTSNHLLLAGPRSEAGHLLLQKLLRAKNVQLSTGRGSEGLRAEINGHIDSKLAGLEQKLQGTPSNKEDAAARKPLTPKPKRVQKASDRLVSSRKKLRKEDGVRASEALLKQLKQELSLLPLTEPAITANFSLFAPFGSGCPVNGQSQLRGAFGSGALPTGPDYYSQLLTKNNLSNPPTPPSSLPPTPPPSVQQKMVNGVTPSEELGEHPKDAASARDSERALRDTSEVKSLDLLAALPTPPHNQTEDVRMESDEDSDSPDSIVPASSPESILGEEAPRFPHLGSGRWEQEDRALSPVIPLIPRASIPVFPDTKPYGALGLEVPGKLPVTTWEKGKGSEVSVMLTVSAAAAKNLNGVMVAVAELLSMKIPNSYEVLFPESPARAGTEPKKGEAEGPGGKEKGLEGKSPDTGPDWLKQFDAVLPGYTLKSQLDILSLLKQESPAPEPPTQHSYTYNVSNLDVRQLSAPPPEEPSPPPSPLAPSPASPPTEPLVELPTEPLAEPPVPSPLPLASSPESARPKPRARPPEEGEDSRPPRLKKWKGVRWKRLRLLLTIQKGSGRQEDEREVAEFMEQLGTALRPDKVPRDMRRCCFCHEEGDGATDGPARLLNLDLDLWVHLNCALWSTEVYETQGGALMNVEVALHRGLLTKCSLCQRTGATSSCNRMRCPNVYHFACAIRAKCMFFKDKTMLCPMHKIKGPCEQELSSFAVFRRVYIERDEVKQIASIIQRGERLHMFRVGGLVFHAIGQLLPHQMADFHSATALYPVGYEATRIYWSLRTNNRRCCYRCSIGENNGRPEFVIKVIEQGLEDLVFTDASPQAVWNRIIEPVAAMRKEADMLRLFPEYLKGEELFGLTVHAVLRIAESLPGVESCQNYLFRYGRHPLMELPLMINPTGCARSEPKILTHYKRPHTLNSTSMSKAYQSTFTGETNTPYSKQFVHSKSSQYRRLRTEWKNNVYLARSRIQGLGLYAAKDLEKHTMVIEYIGTIIRNEVANRREKIYEEQNRGIYMFRINNEHVIDATLTGGPARYINHSCAPNCVAEVVTFDKEDKIIIISSRRIPKGEELTYDYQFDFEDDQHKIPCHCGAWNCRKWMN

SEQ ID NO: 54458 - protein, 146 aa, Homo sapiens
MDSQKLAGEDKDSEPAADGPAASEDPSATESDLPNPHVGEVSVLSSGSPRLQETPQDCSGGPVRRCALCNCGEPSLHGQRELRRFELPFDWPRCPVVSPGGSPGPNEAVLPSEDLSQIGFPEGLTPAHLGEPGGSCWAHHWCAAWS

SEQ ID NO: 54459 - protein, 4911 aa, Homo sapiens
MSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVVSGSTERCAFCKHLGATIKCCEEKCTQMYHYPCAAGAGTFQDFSHIFLLCPEHIDQAPERSKEDANCAVCDSPGDLLDQFFCTTCGQHYHGMCLDIAVTPLKRAGWQCPECKVCQNCKQSGEDSKMLVCDTCDKGYHTFCLQPVMKSVPTNGWKCKNCRICIECGTRSSSQWHHNCLICDNCYQQQDNLCPFCGKCYHPELQKDMLHCNMCKRWVHLECDKPTDHELDTQLKEEYICMYCKHLGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 54460 - protein, 4968 aa, Homo sapiens
MSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRCVEWSLGVCQMEEPLLVNVDKAVVSGSTERCAFCKHLGATIKCCEEKCTQMYHYPCAAGAGTFQDFSHIFLLCPEHIDQAPERSKEDANCAVCDSPGDLLDQFFCTTCGQHYHGMCLDIAVTPLKRAGWQCPECKVCQNCKQSGEDSKMLVCDTCDKGYHTFCLQPVMKSVPTNGWKCKNCRICIECGTRSSSQWHHNCLICDNCYQQQDNLCPFCGKCYHPELQKDMLHCNMCKRWVHLECDKPTDHELDTQLKEEYICMYCKHLGAEMDRLQPGEEVEIAELTTDYNNEMEVEGPEDQMVFSEQAANKDVNGQESTPGIVPDAVQVHTEEQQKSHPSESLDTDSLLIAVSSQHTVNTELEKQISNEVDSEDLKMSSEVKHICGEDQIEDKMEVTENIEVVTHQITVQQEQLQLLEEPETVVSREESRPPKLVMESVTLPLETLVSPHEESISLCPEEQLVIERLQGEKEQKENSELSTGLMDSEMTPTIEGCVKDVSYQGGKSIKLSSETESSFSSSADISKADVSSSPTPSSDLPSHDMLHNYPSALSSSAGNIMPTTYISVTPKIGMGKPAITKRKFSPGRPRSKQGAWSTHNTVSPPSWSPDISEGREIFKPRQLPGSAIWSIKVGRGSGFPGKRRPRGAGLSGRGGRGRSKLKSGIGAVVLPGVSTADISSNKDDEENSMHNTVVLFSSSDKFTLNQDMCVVCGSFGQGAEGRLLACSQCGQCYHPYCVSIKITKVVLSKGWRCLECTVCEACGKATDPGRLLLCDDCDISYHTYCLDPPLQTVPKGGWKCKWCVWCRHCGATSAGLRCEWQNNYTQCAPCASLSSCPVCYRNYREEDLILQCRQCDRWMHAVCQNLNTEEEVENVADIGFDCSMCRPYMPASNVPSSDCCESSLVAQIVTKVKELDPPKTYTQDGVCLTESGMTQLQSLTVTVPRRKRSKPKLKLKIINQNSVAVLQTPPDIQSEHSRDGEMDDSREGELMDCDGKSESSPEREAVDDETKGVEGTDGVKKRKRKPYRPGIGGFMVRQRSRTGQGKTKRSVIRKDSSGSISEQLPCRDDGWSEQLPDTLVDESVSVTESTEKIKKRYRKRKNKLEETFPAYLQEAFFGKDLLDTSRQSKISLDNLSEDGAQLLYKTNMNTGFLDPSLDPLLSSSSAPTKSGTHGPADDPLADISEVLNTDDDILGIISDDLAKSVDHSDIGPVTDDPSSLPQPNVNQSSRPLSEEQLDGILSPELDKMVTDGAILGKLYKIPELGGKDVEDLFTAVLSPANTQPTPLPQPPPPTQLLPIHNQDAFSRMPLMNGLIGSSPHLPHNSLPPGSGLGTFSAIAQSSYPDARDKNSAFNPMASDPNNSWTSSAPTVEGENDTMSNAQRSTLKWEKEEALGEMATVAPVLYTNINFPNLKEEFPDWTTRVKQIAKLWRKASSQERAPYVQKARDNRAALRINKVQMSNDSMKRQQQQDSIDPSSRIDSELFKDPLKQRESEHEQEWKFRQQMRQKSKQQAKIEATQKLEQVKNEQQQQQQQQFGSQHLLVQSGSDTPSSGIQSPLTPQPGNGNMSPAQSFHKELFTKQPPSTPTSTSSDDVFVKPQAPPPPPAPSRIPIQDSLSQAQTSQPPSPQVFSPGSSNSRPPSPMDPYAKMVGTPRPPPVGHSFSRRNSAAPVENCTPLSSVSRPLQMNETTANRPSPVRDLCSSSTTNNDPYAKPPDTPRPVMTDQFPKSLGLSRSPVVSEQTAKGPIAAGTSDHFTKPSPRADVFQRQRIPDSYARPLLTPAPLDSGPGPFKTPMQPPPSSQDPYGSVSQASRRLSVDPYERPALTPRPIDNFSHNQSNDPYSQPPLTPHPAVNESFAHPSRAFSQPGTISRPTSQDPYSQPPGTPRPVVDSYSQSSGTARSNTDPYSQPPGTPRPTTVDPYSQQPQTPRPSTQTDLFVTPVTNQRHSDPYAHPPGTPRPGISVPYSQPPATPRPRISEGFTRSSMTRPVLMPNQDPFLQAAQNRGPALPGPLVRPPDTCSQTPRPPGPGLSDTFSRVSPSAARDPYDQSPMTPRSQSDSFGTSQTAHDVADQPRPGSEGSFCASSNSPMHSQGQQFSGVSQLPGPVPTSGVTDTQNTVNMAQADTEKLRQRQKLREIILQQQQQKKIAGRQEKGSQDSPAVPHPGPLQHWQPENVNQAFTRPPPPYPGNIRSPVAPPLGPRYAVFPKDQRGPYPPDVASMGMRPHGFRFGFPGGSHGTMPSQERFLVPPQQIQGSGVSPQLRRSVSVDMPRPLNNSQMNNPVGLPQHFSPQSLPVQQHNILGQAYIELRHRAPDGRQRLPFSAPPGSVVEASSNLRHGNFIPRPDFPGPRHTDPMRRPPQGLPNQLPVHPDLEQVPPSQQEQGHSVHSSSMVMRTLNHPLGGEFSEAPLSTSVPSETTSDNLQITTQPSDGLEEKLDSDDPSVKELDVKDLEGVEVKDLDDEDLENLNLDTEDGKVVELDTLDNLETNDPNLDDLLRSGEFDIIAYTDPELDMGDKKSMFNEELDLPIDDKLDNQCVSVEPKKKEQENKTLVLSDKHSPQKKSTVTNEVKTEVLSPNSKVESKCETEKNDENKDNVDTPCSQASAHSDLNDGEKTSLHPCDPDLFEKRTNRETAGPSANVIQASTQLPAQDVINSCGITGSTPVLSSLLANEKSDNSDIRPSGSPPPPTLPASPSNHVSSLPPFIAPPGRVLDNAMNSNVTVVSRVNHVFSQGVQVNPGLIPGQSTVNHSLGTGKPATQTGPQTSQSGTSSMSGPQQLMIPQTLAQQNRERPLLLEEQPLLLQDLLDQERQEQQQQRQMQAMIRQRSEPFFPNIDFDAITDPIMKAKMVALKGINKVMAQNNLGMPPMVMSRFPFMGQVVTGTQNSEGQNLGPQAIPQDGSITHQISRPNPPNFGPGFVNDSQRKQYEEWLQETQQLLQMQQKYLEEQIGAHRKSKKALSAKQRTAKKAGREFPEEDAEQLKHVTEQQSMVQKQLEQIRKQQKEHAELIEDYRIKQQQQCAMAPPTMMPSVQPQPPLIPGATPPTMSQPTFPMVPQQLQHQQHTTVISGHTSPVRMPSLPGWQPNSAPAHLPLNPPRIQPPIAQLPIKTCTPAPGTVSNANPQSGPPPRVEFDDNNPFSESFQERERKERLREQQERQRIQLMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQVRQLSLLPLMEPIIGVNFAHFLPYGSGQFNSGNRLLGTFGSATLEGVSDYYSQLIYKQNNLSNPPTPPASLPPTPPPMACQKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRFVLRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 54461 - protein, 1524 aa, Homo sapiens
LMQEVDRQRALQQRMEMEQHGMVGSEISSSRTSVSQIPFYSSDLPCDFMQPLGPLQQSPQHQQQMGQVLQQQNIQQGSINSPSTQTFMQTNERRQVGPPSFVPDSPSIPVGSPNFSSVKQGHGNLSGTSFQQSPVRPSFTPALPAAPPVANSSLPCGQDSTITHGHSYPGSTQSLIQLYSDIIPEEKGKKKRTRKKKRDDDAESTKAPSTPHSDITAPPTPGISETTSTPAVSTPSELPQQADQESVEPVGPSTPNMAAGQLCTELENKLPNSDFSQATPNQQTYANSEVDKLSMETPAKTEEIKLEKAETESCPGQEEPKLEEQNGSKVEGNAVACPVSSAQSPPHSAGAPAAKGDSGNELLKHLLKNKKSSSLLNQKPEGSICSEDDCTKDNKLVEKQNPAEGLQTLGAQMQGGFGCGNQLPKTDGGSETKKQRSKRTQRTGEKAAPRSKKRKKDEEEKQAMYSSTDTFTHLKQQLSLLPLMEPIIGVNFAHFLPYGSGQFNSGNRLLGTFGSATLEGVSDYYSQLIYKKMANGFATTEELAGKAGVLVSHEVTKTLGPKPFQLPFRPQDDLLARALAQGPKTVDVPASLPTPPHNNQEELRIQDHCGDRDTPDSFVPSSSPESVVGVEVSRYPDLSLVKEEPPEPVPSPIIPILPSTAGKSSESRRNDIKTEPGTLYFASPFGPSPNGPRSGLISVAITLHPTAAENISSVVAAFSDLLHVRIPNSYEVSSAPDVPSMGLVSSHRINPGLEYRQHLLLRGPPPGSANPPRLVSSYRLKQPNVPFPPTSNGLSGYKDSSHGIAESAALRPQWCCHCKVVILGSGVRKSFKDLTLLNKDSRESTKRVEKDIVFCSNNCFILYSSTAQAKNSENKESIPSLPQSPMRETPSKAFHQYSNNISTLDVHCLPQLPEKASPPASPPIAFPPAFEAAQVEAKPDELKVTVKLKPRLRAVHGGFEDCRPLNKKWRGMKWKKWSIHIVIPKGTFKPPCEDEIDEFLKKLGTSLKPDPVPKDYRKCCFCHEEGDGLTDGPARLLNLDLDLWVHLNCALWSTEVYETQAGALINVELALRRGLQMKCVFCHKTGATSGCHRFRCTNIYHFTCAIKAQCMFFKDKTMLCPMHKPKGIHEQELSYFAVFRRVYVQRDEVRQIASIVQRGERDHTFRVGSLIFHTIGQLLPQQMQAFHSPKALFPVGYEASRLYWSTRYANRRCRYLCSIEEKDGRPVFVIRIVEQGHEDLVLSDISPKGVWDKILEPVACVRKKSEMLQLFPAYLKGEDLFGLTVSAVARIAESLPGVEACENYTFRYGRNPLMELPLAVNPTGCARSEPKMSAHVKRPHTLNSTSTSKSFQSTVTGELNAPYSKQFVHSKSSQYRKMKTEWKSNVYLARSRIQGLGLYAARDIEKHTMVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 54462 - protein, 116 aa, Homo sapiens
MVIEYIGTIIRNEVANRKEKLYESQNRGVYMFRMDNDHVIDATLTGGPARYINHSCAPNCVAEVVTFERGHKIIISSSRRIQKGEELCYDYKFDFEDDQHKIPCHCGAVNCRKWMN

SEQ ID NO: 54463 - protein, 1858 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLPPPPPPPGPAPHHHPPPHPSTGLQGLQAQHQHVVNSAPPPPPPPPPSSVLASGHHTTSAQALHHPPHQGPPLFPSSAHPTVPPYPSQATHHTTLGPGPQHQPSGTGPHCPLPVTGPHLQPQGPNSIPTPTASGFCPHPGSVALPHGVQGPQQASPVPGQIPIHRAQVPPTFQNNYHGSGWH

SEQ ID NO: 54464 - protein, 1858 aa, Homo sapiens; identical to SEQ ID NO: 54463

SEQ ID NO: 54465 - protein, 1816 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLPPPPPPPGPAPHHHPPPHPSTGLQGLQAQHQHVVNSAPPPPPPPPPSSVLASGHHTTSAQALHHPPHQGPPLFPSSAHPTVPPYPSQATHHTTLGPGPQHQPSGTGPHCPLPVTGPHLQPQGPNSIPTPTASGFCPHPGSVALPHGVQGPQQASPVPGQIPIHRAQVPPTFQNNYHGSGWH

SEQ ID NO: 54466 - protein, 589 aa, Homo sapiens
MHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYTQR

SEQ ID NO: 54467 - protein, 1778 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPANTQQATSGTLFTQTPSGQSSATYSQFNQQSLNSTAPPPPPPPPPSSSYYQNQQPSANFQNYNQLKGSLSQQTVFTSGPNQALPGTTSQQTVPGHHVTPGHFLPSQNPTIHHQTAAAVVPPPPPPPPAPGPHLVQQPNSHQQHSVAHVVGPVHAVTPGSHIHSQTAGHHLPPPPPPPGPAPHHHPPPHPSTGLQGLQAQHQHVVNSAPPPPPPPPPSSVLASGHHTTSAQALHHPPHQGPPLFPSSAHPTVPPYPSQATHHTTLGPGPQHQPSGTGPHCPLPVTGPHLQPQGPNSIPTPTASGFCPHPGSVALPHGVQGPQQASPVPGQIPIHRAQVPPTFQNNYHGSGWH

SEQ ID NO: 54468 - protein, 1653 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMTREERKMEAILQAFARLEKREKRREQALERISTAKTEVKTECKDTQIVSDAEVIQEQAKEENASKPTPAKVNRTKQRKSFSRSRTHIGQQRRRHRTVSMCSDIQPSSPDIEVTSQQNDIENTVLTIEPETETALAEIITETEVPALNKCPTKYPKTKKHLVNEWLSEKNEKTGKPSDGLSERPLRITTDPEVLATQLNSLPGLTYSPHVYSTPKHYIRFTSPFLSEKRRRKEPTENISGSCKKRWLKQALEEENSAILHRFNSPCQERSRSPAVNGENKSPLLLNDSCSLPDLTTPLKKRRFYQLLDSVYSETSTPTPSPYATPTHTDITPMDPSFATPPRIKSDDETCRNGYKPIYSPVTPVTPGTPGNTMHFENISSPESSPEIKRRTYSQEGYDRSSTMLTLGPFRNSNLTELGLQEIKTIGYTSPRSRTEVNRQCPGEKEPVSDLQLGLDAVEPTALHKTLETPAHDRAEPNSQLDSTHSGRGTMYSSWVKSPDRTGVNFSVNSNLRDLTPSHQLEVGGGFRISESKCLMQDDTRGMFMETTVFCTSEDGLVSGFGRTVNDNLIDGNCTPQNPPQKKKVSLLEYRKRQREARKSGSKTENFPLISVSPHASGSLSNNGDGCASSNDNGEQVDHTASLPLPTPATVYNATSEETSNNCPVKDATASEKNEPEVQWTASTSVEQVRERSYQRALLLSDHRKDKDSGGESPCVSCSPSHVQSSPSSHSNHIPQLQAKGPVPSFSELMEDPDPENPEPTTTNECPSPDTSQNTCKSPPKMSKPGSPGSVIPAQAHGKIFTKPDPQWDSTVSASEAENGVHLKTELQQKQLSNNNQALSKNHPPQTHVRNSSEQLSQKLPSVPTKLHCPPSPHLENPPKSSTPHTPVQHGYLSPKPPSQQLGSPYRPHHSQSPQVGTPQREPQRNFYPAAQNLPVFWLLGIIPHQLKPYTTHLIKDLHFFLRVLIQLYHRIPHKLHIIPLWDRDPSTSLLEQGHIVHYLSQVLISSPKDQTVFQHLLLQGSVLILALWPCHMGFKDLSRHLQCLDRFQFTEHRCHQHFKTITMGQGGIKMDSKNIFLNVL

SEQ ID NO: 54469 - protein, 125 aa, Homo sapiens
  MOD_RES (1)..(1): Any amino acid
XGSLSNNGDGCASSNDNGEQVDHTASLPLPTPATVYNATSEETSNNCPVKDATASEKNEPEVQWTASTSVEQVRERSYQRALLLSDHRKDKDSDPDPENPEPTTTNECPSPDTSQNTCKSPPKMS

SEQ ID NO: 54470 - protein, 71 aa, Homo sapiens
MSIVIPLGVDTAETSYLEMAAGSEPESVEASPVVVEKSNSYPHQLYTSSSHHSHSYIGLPYADHNYGARPP

SEQ ID NO: 54471 - protein, 609 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKKSGEKEQHISKCKKAFREGSRKSSRVKGSAPEIDPSSDGSNFGWETKIKAWMDRYEEANNNQYSEGVQREAQRIALRLGNGNDKKEMNKSDLNTNNLLFKPPVESHIQKNKKILKSAKDLPPDALIIEYRGKFMLREQFEANGYFFKRPYPFVLFYSKFHGLEMCVDARTFGNEARFIRRSCTPNAEVRHEIQDGTIHLYIYSIHSIPKGTEITIAFDFDYGNCKYKVDCACLKENPECPVLKRSSESMENINSGYETRRKKGKKDKDISKEKDTQNQNITLDCEGTTNKMKSPETKQRKLSPLRLSVSNNQEPDFIDDIEEKTPISNEVEMESEEQIAERKRKMVSWEASSLGLVTAALHMVIVAAFTWAFTLFFEVSE

SEQ ID NO: 54472 - protein, 230 aa, Homo sapiens
MSIVIPLGVDTAETSYLEMAAGSEPESVEASPVVVEKSNSYPHQLYTSSSHHSHSYIGLPYADHNYGARPPPTPPASPPPSVLISKNEVGIFTTPNFDETSSATTISTSEDGSYGTDVTRCICGFTHDDGYMICCDKCSVWQHIDCMGIDRQHIPDTYLCERCQPRNLDKERAVLLQRRKRENMSDGDTSATESGDEVPVELYTAFQHTPTSITLTASRVSKVNDKRRKK

SEQ ID NO: 54473 - protein, 453 aa, Homo sapiens [sequence omitted]

SEQ ID NO: 54474 - protein, 322 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 54475 - protein, 322 aa, Homo sapiens; identical to SEQ ID NO: 54474

SEQ ID NO: 54476 - protein, 322 aa, Homo sapiens; identical to SEQ ID NO: 54474

SEQ ID NO: 54477 - protein, 322 aa, Homo sapiens; identical to SEQ ID NO: 54474

SEQ ID NO: 54478 - protein, 322 aa, Homo sapiens; identical to SEQ ID NO: 54474

SEQ ID NO: 54479 - protein, 147 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIA

SEQ ID NO: 54480 - protein, 285 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWPLYQFDEKYGGQPRRSRDVSCSRSHAYYVCAWDRRLAVAILTAINLLAYVADLVHSAHLVFVKV

SEQ ID NO: 54481 - protein, 242 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSG

SEQ ID NO: 54482 - protein, 259 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIFAFISDPNLYQHQPALEWCVAVYAICFILAAIAILLNLGECTNVLPIPFPSFLSGLALLSVLLYATALVLWP

SEQ ID NO: 54483 - protein, 188 aa, Homo sapiens
MPVTVTRTTITTTTTSSSGLGSPMIVGSPRALTQPLGLLRLLQLVSTCVAFSLVASVGAWTGSMGNWSMFTWCFCFSVTLIILIVELCGLQARFPLSWRNFPITFACYAALFCLSASIIYPTTYVQFLSHGRSRDHAIAATFFSCIACVAYATEVAWTRARPGEITGYMATVPGLLKVLETFVACIIF

SEQ ID NO: 54484 - protein, 313 aa, Homo sapiens
MALRICVTYTPALPIGLCTRCCLCLEQSPSWCHCLRGVSFLTFHLHQSVPLGDRDSLLMFTRQAGHFVEGSKAGRSRGRLCLSQALRVAVRGAFVSLWFAAGAGDRERNKGDKGAQTGAGLSQEAEDVDVSRARRVTDAPQGTLCGTGNRNSGSQSARVVGVAHLGEAFRVGVEQAISSCPEEVHGRHGLSMEIMWARMDVALRSPGRGLLAGAGALCMTLAESSCPDYERGRRACLTLHRHPTPHCSTWGLPLRVAGSWLTVVTVEALGGWRMGVRRTGQVGPTMHPPPVSGASPLLLHHLLLLLLIIILTC

SEQ ID NO: 54485 - protein, 313 aa, Homo sapiens; identical to SEQ ID NO: 54484

SEQ ID NO: 54486 - protein, 745 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 54487 - protein, 777 aa, Homo sapiens
MGVPFFSSLRCMVDLGPCWAGGLTAEMKLLLALAGLLAILATPQPSEGAAPAVLGEVDTSLVLSSMEEAKQLVDKAYKERRESIKQRLRSGSASPMELLSYFKQPVAATRTAVRAADYLHVALDLLERKLRSLWRRPFNVTDVLTPAQLNVLSKSSGCAYQDVGVTCPEQDKYRTITGMCNNRCGWLGVAAGTGLREASRTPQASRCQRPVLPCRRSPTLGASNRAFVRWLPAEYEDGFSLPYGWTPGVKRNGFPVALARAVSNEIVRFPTDQLTPDQERSLMFMQWGQLLDHDLDFTPEPAARASFVTGVNCETSCVQQPPCFPLKIPPNDPRIKNQADCIPFFRSCPACPGSNITIRNQINALTSFVDASMVYGSEEPLARNLRNMSNQLGLLAVNQRFQDNGRALLPFDNLHDDPCLLTNRSARIPCFLAGDTRSSEMPELTSMHTLLLREHNRLATELKSLNPRWDGERLYQEARKIVGAMVQIITYRDYLPLVLGPTAMRKYLPTYRSYNDSVDPRIANVFTNAFRYGHTLIQPFMFRLDNRYQPMEPNPRVPLSRVFFASWRVVLEGGIDPILRGLMATPAKLNRQNQIAVDEIRERLFEQVMRIGLDLPALNMQRSRDHGLPGYNAWRRFCGLPQPETVGQLGTVLRNLKLARKLMEQYGTPNNIDIWMGGVSEPLKRKGRVGPLLACIIGTQFRKLRDGDRFWWENEGVFSMQQRQALAQISLPRIICDNTGITTVSKNNIFMSNSYPRDFVNCSTLPALNLASWREAS

SEQ ID NO: 54488 - protein, 513 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLL

SEQ ID NO: 54489 - protein, 635 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRRLRHALWPSLPDLHRVLGQYLRDTAALSPPKATVSDTCEEVEPSLLEILPKSSERTPLPLCSSQAQMDYRRLQPSCLGTMPLSVCPPMAESGSCCTTHIANHSYLPLSYWQQP

SEQ ID NO: 54490 - protein, 549 aa, Homo sapiens
MPSWALFMVTSCLLLAPQNLAQVSSQDVSLLASDSEPLKCFSRTFEDLTCFWDEEEAAPSGTYQLLYAYPREKPRACPLSSQSMPHFGTRYVCQFPDQEEVRLFFPLHLWVKNVFLNQTRTQRVLFVDSVGLPAPPSIIKAMGGSQPGELQISWEEPAPEISDFLRYELRYGPRDPKNSTGPTVIQLIATETCCPALQRPHSASALDQSPCAQPTMPWQDGPKQTSPSREASALTAEGGSCLISGLQPGNSYWLQLRSEPDGISLGGSWGSWSLPVTVDLPGDAVALGLQCFTLDLKNVTCQWQQQDHASSQGFFYHSRARCCPRDRYPIWENCEEEEKTNPGLQTPQFSRCHFKSRNDSIIHILVEVTTAPGTVHSYLGSPFWIHQAVRLPTPNLHWREISSGHLELEWQHPSSWAAQETCYQLRYTGEGHQDWKVLEPPLGARGGTLELRPRSRYRLQLRARLNGPTYQGPWSSWSDPTRVETATETAWISLVTALHLVLGLSAVLGLLLLRWQFPAHYRYRPRQAGDWRWTRWSRRPVNRHSWFAL

SEQ ID NO: 54491 - protein, 938 aa, Homo sapiens
MTLLGSEHSLLIRSKFRSVLQLRLQQRRTQEQLANQGIIPPLKRPAEFHEQRKHLDSDKAKNSLKRKARNRCNSADLVNMHILQASTAERSIPTAQMKLKRARLADDLNEKIALRPGPLELVEKNILPVDSAVKEAIKGNQVSFSKSTDAFAFEEDSSSDGLSPDQTRSEDPQNSAGSPPDAKASDTPSTGSLGTNQDLASGSENDRNDSASQPSHQSDAGKQGLGPPSTPIAVHAAVKSKSLGDSKNRHKKPKDPKPKVKKLKYHQYIPPDQKAEKSPPPMDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQMAGLHSSDKVGPKFSIPSPTFSKSSSAISEVTQPPSYEDAVKQQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 54492 - protein, 662 aa, Homo sapiens
MDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 54493 - protein, 684 aa, Homo sapiens
MKLKRARLADDLNEKIALRPGPLELVEKNILPVDSAVKEAIKGNQVSFSKSTDAFAFEEDSSSDGLSPDQTRSEDPQNSAGSPPDAKASDTPSTGSLGTNQDLASGSENDRNDSASQPSHQSDAGKQGLGPPSTPIAVHAAVKSKSLGDSKNRHKKPKDPKPKVKKLKYHQYIPPDQKAEKSPPPMDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKMAGLHSSDKVGPKFSIPSPTFSKSSSAISEVTQPPSYEDAVKQVTM

SEQ ID NO: 54494 - protein, 986 aa, Homo sapiens
MTLLGSEHSLLIRSKFRSVLQLRLQQRRTQEQLANQGIIPPLKRPAEFHEQRKHLDSDKAKNSLKRKARNRCNSADLVNMHILQASTAERSIPTAQMKLKRARLADDLNEKIALRPGPLELVEKNILPVDSAVKEAIKGNQVSFSKSTDAFAFEEDSSSDGLSPDQTRSEDPQNSAGSPPDAKASDTPSTGSLGTNQDLASGSENDRNDSASQPSHQSDAGKQGLGPPSTPIAVHAAVKSKSLGDSKNRHKKPKDPKPKVKKLKYHQYIPPDQKAEKSPPPMDSAYARLLQQQQLFLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKMAGLHSSDKVGPKFSIPSPTFSKSSSAISEVTQPPSYEDAVKQQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 54495 - protein, 648 aa, Homo sapiens
FLQLQILSQQQQQQQHRFSYLGMHQAQLKEPNEQMVRNPNSSSTPLSNTPLSPVKNSFSGQTGVSSFKPGPLPPNLDDLKVSELRQQLRIRGLPVSGTKTALMDRLRPFQDCSGNPVPNFGDITTVTFPVTPNTLPNYQSSSSTSALSNGFYHFGSTSSSPPISPASSDLSVAGSLPDTFNDASPSFGLHPSPVHVCTEESLMSSLNGGSVPSELDGLDSEKDKMLVEKQKVINELTWKLQQEQRQVEELRMQLQKQKRNNCSEKKPLPFLAASIKQEEAVSSCPFASQVPVKRQSSSSECHPPACEAAQLQPLGNAHCVESSDQTNVLSSTFLSPQCSPQHSPLGAVKSPQHISLPPSPNNPHFLPSSSGAQGEGHRVSSPISSQVCTAQNSGAHDGHPPSFSPHSSSLHPPFSGAQADSSHGAGGNPCPKSPCVQQKQMTRSQQMDELLDVLIESGEMPADAREDHSCLQKVPKIPRSSRSPTAVLTKPSASFEQASSGSQIPFDPYATDSDEHLEVLLNSQSPLGKMSDVTLLKIGSEEPHFDGIMDGFSGKAAEDLFNAHEILPGPLSPMQTQFSPSSVDSNGLQLSFTESPWETMEWLDLTPPNSTPGFSALTTSSPSIFNIDFLDVTDLNLNSSMDLHLQQW

SEQ ID NO: 54496 - protein, 504 aa, Homo sapiens
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 54497 - protein, 457 aa, Homo sapiens
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 54498 - protein, 437 aa, Homo sapiens
MSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFQGAESRTVIRYELNTETVKAEKEIPGAGYHGQFPYSWGGYTDIDLAVDEAGLWVIYSTDEAKGAIVLSKLNPENLELEQTWETNIRKQSVANAFIICGTLYTVSSYTSADATVNFAYDTGTGISKTLTIPFKNRYKYSSMIDYNPLEKKLFAWDNLNMVTYDIKLSKM

SEQ ID NO: 54499 - protein, 344 aa, Homo sapiens
MRFFCARCCSFGPEMPAVQLLLLACLVWDVGARTAQLRKANDQSGRCQYTFSVASPNESSCPEQSQAMSVIHNLQRDSSTQRLDLEATKARLSSLESLLHQLTLDQAARPQETQEGLQRELGTLRRERDQLETQTRELETAYSNLLRDKSVLEEEKKRLRQENENLARRLESSSQEVARLRRGQCPQTRDTARAVPPGSREVSTWNLDTLAFQELKSELTEVPASRILKESPSGYLRSGEGDTGCGELVWVGEPLTLRTAETITGKYGVWMRDPKPTYPYTQETTWRIDTVGTDVRQVFEYDLISQFMQGYPSKVHILPRPLESTGAVVYSGSLYFRALSPELS

SEQ ID NO: 54500 - protein, 506 aa, Homo sapiens
MGRKKIQITRIMDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLYLKRQLNTNNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54501 - protein, 499 aa, Homo sapiens
MGRKKIQITRIMDERNRQVTFTKRKFGLMKKAYELSVLCDCEIALIIFNSSNKLFQYASTDMDKVLLKYTEYNEPHESRTNSDIVEALNKKEHRGCDSPDPDTSYVLTPHTEEKYKKINEEFDNMMRNHKIAPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54502 - protein, 429 aa, Homo sapiens
MGRKKIQITRIMDERNRQTLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54503 - protein, 497 aa, Homo sapiens
MGRKKIQITRIMDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54504 - protein, 497 aa, Homo sapiens; identical to SEQ ID NO: 54503

SEQ ID NO: 54505 - protein, 505 aa, Homo sapiens
MGRKKIQITRIMDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54506 - protein, 38 aa, Homo sapiens
MGRKKIQITRIMDERNRQVTFTKRKFGLMKKAYELSVL

SEQ ID NO: 54507 - protein, 437 aa, Homo sapiens
MGRKKIQITRIMDERNRQTLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLSEEEELELNTQRISSSQATQPLATPVVSVTTPSLPPQGLVYSAMPTAYNTDYSLTSADLSALQGFNSPGMLSLGQVSAWQQHHLGQAALSSLVAGGQLSQGSNLSINTNQNISIKSEPISPPRDRMTPSGFQQQQQQQQQQQPPPPPQPQPQPPQPQPRQEMGRSPVDSLSSSSSSYDGSDREDPRGDFHSPIVLGRPPNTEDRESPSVKRMRMDAWVT

SEQ ID NO: 54508 - protein, 77 aa, Homo sapiens
MGRKKIQITRIMDERNRQVTFTKRKFGLMKKAYELSVLCDCEIALIIFNSSNKLFQYASTDMDKVLLKYTEYNEPHE

SEQ ID NO: 54509 - protein, 85 aa, Homo sapiens
MGRKKIQITRIMDERNRQVTFTKRKFGLMKKAYELSVLCDCEIALIIFNSSNKLFQYASTDMDKVLLKYTEYNEPHESRTNSDIV

SEQ ID NO: 54510 - protein, 368 aa, Homo sapiens
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPSGGRSLGEEGPPTRGASPPTPPVSIKSERLSPAPGGPGDFPKTFPYPLLLARSLAEPLRPGPALRRLPLADGWPR

SEQ ID NO: 54511 - protein, 297 aa, Homo sapiens
MGRKKIQISRILDQRNRQVTFTKRKFGLMKKAYELSVLCDCEIALIIFNSANRLFQYASTDMDRVLLKYTEYSEPHESRTNTDILEVPQTLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPEYGLGDPPPPPGLLQPPTLAPWQPSRGDGPPAVSSQPR

SEQ ID NO: 54512 - protein, 368 aa, Homo sapiens; identical to SEQ ID NO: 54510

SEQ ID NO: 54513 - protein, 365 aa, Homo sapiens
MGRKKIQISRILDQRNRQVTFTKRKFGLMKKAYELSVLCDCEIALIIFNSANRLFQYASTDMDRVLLKYTEYSEPHESRTNTDILETLKRRGIGLDGPELEPDEGPEEPGEKFRRLAGEGGDPALPRPRLYPAAPAMPSPDVVYGALPPPGCDPSGLGEALPAQSRPSPFRPAAPKAGPPGLVHPLFSPSHLTSKTPPPLYLPTEGRRSDLPGGLAGPRGGLNTSRSLYSGLQNPCSTATPGPPLGSFPFLPGGPPVGAEAWARRVPQPAAPPRRPPQSASSLSASLRPPGAPATFLRPSPIPCSSPGPWQSLCGLGPPCAGCPWPTAGPGRRSPGGTSPERSPGTARARGDPTSLQASSEKTQQ

SEQ ID NO: 54514 - protein, 463 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54515 - protein, 473 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54516 - protein, 98 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDS

SEQ ID NO: 54517 - protein, 129 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMIS

SEQ ID NO: 54518 - protein, 87 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVET

SEQ ID NO: 54519 - protein, 473 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVVIQNYILKNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54520 - protein, 227 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSP

SEQ ID NO: 54521 - protein, 120 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINE

SEQ ID NO: 54522 - protein, 126 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDL

SEQ ID NO: 54523 - protein, 28 aa, Homo sapiens
MGRKKIQITRIMDERNRQVTFTKRKFGL

SEQ ID NO: 54524 - protein, 465 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54525 - protein, 242 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVEALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPM

SEQ ID NO: 54526 - protein, 441 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSVGHSPESEDKYRKINEDIDLMISRQRLCAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVSEDVDLLLNQRINNSQSAQSLATPVVSVATPTLPGQGMGGYPSAISTTYGTEYSLSSADLSSLSGFNTASALHLGSVTGWQQQHLHNMPPSALSQLGDRTTTPSRYPQHTRHEAGRSPVDSLSSCSSSYDGSDREDHRNEFHSPIGLTRPSPDERESPSVKRMRLSEGWAT

SEQ ID NO: 54527 - protein, 473 aa, Homo sapiens; identical to SEQ ID NO: 54515

SEQ ID NO: 54528 - protein, 417 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVEAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54529 - protein, 483 aa, Homo sapiens
MGRKKIQITRIMDERNRQVTFTKRKFGLMKKAYELSVLCDCEIALIIFNSTNKLFQYASTDMDKVLLKYTEYNEPHESRTNSDIVETLRKKGLNGCDSPDPDADDSALNKKENKGCESPDPDSSYALTPRTEEKYKKINEEFDNMIKSHKIPAVPPPNFEMPVSIPVSSHNSLVYSNPVSSLGNPNLLPLAHPSLQRNSMSPGVTHRPPSAGNTGGLMGGDLTSGAGTSAGNGYGNPRNSPGLLVSPGNLNKNMQAKSPPPMNLGMNNRKPDLRVLIPPGSKNTMPSVNQRINNSQSAQSLATPVVSVATPTLPGQGMGGYPSAISTTYGTEYSLSSADLSSLSGFNTASALHLGSVTGWQQQHLHNMPPSALSQLGACTSTHLSQSSNLSLPSTQSLNIKSEPVSPPRDRTTTPSRYPQHTRHEAGRSPVDSLSSCSSSYDGSDREDHRNEFHSPIGLTRPSPDERESPSVKRMRLSEGWAT

SEQ ID NO: 54530 - protein, 520 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIEALHKKHRECESPEVDEVFALTPQTEEKYKKIDEEFDKMMQSYRLASTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 54531 - protein, 521 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 54532 - protein, 475 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIESTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLTEDHLDLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 54533 - protein, 514 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTWTLK

SEQ ID NO: 54534 - protein, 514 aa, Homo sapiens; identical to SEQ ID NO: 54533

SEQ ID NO: 54535 - protein, 510 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIEALHKKHRECESPEVDEVFALTPQTEEKYKKIDEEFDKMMQSYRLASTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPPTHSTQLGAPSRKPDLRVITSQAGKGLMHHLNNAQRLGVSQSTHSLTTPVVSVATPSLLSQGLPFSSMPTAYNTDYQLTSAELSSLPAFSSPGGLSLGNVTAWQQPQQPQQPQQPQPPQQQPPQPQQPQPQQPQQPQQPPQQQSHLVPVSLSNLIPGSPLPHVGAALTVTTHPHISIKSEPVSPSRERSPAPPPPAVFPAARPEPGDGLSSPAGGSYETGDRDDGRGDFGPTLGLLRPAPEPEAEGSAVKRMRLDTW

SEQ ID NO: 54536 - protein, 139 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGGPCWGVT

SEQ ID NO: 54537 - protein, 246 aa, Homo sapiens
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESADCLEICMECCGLCFSS

SEQ ID NO: 54538 - protein, 246 aa, Homo sapiens; identical to SEQ ID NO: 54537

SEQ ID NO: 54539 - protein, 231 aa, Homo sapiens
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCDLPCDLDCGILDACCESAD

SEQ ID NO: 54540 - protein, 213 aa, Homo sapiens
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHRKLQTHPSLASQGSKKSKSSSKSTTSQIPLQAQEDCCVHCILSCLFCEFLTLCNIVLDCATCGSCSSEDSCLCCCCCGSGECADCD

SEQ ID NO: 54541 - protein, 98 aa, Homo sapiens
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTP

SEQ ID NO: 54542 - protein, 128 aa, Homo sapiens
MYQVSGQRPSGCDAPYGAPSAAPGPAQTLSLLPGLEVVTGSTHPAEAAPEEGSLEEAATPMPQGNGPGIPQGLDSTDLDVPTEAVTCQPQGNPLGCTPLLPNDSGHPSELGGTRRAGNGALGGPKAHR

SEQ ID NO: 54543 - protein, 246 aa, Homo sapiens; identical to SEQ ID NO: 54537

SEQ ID NO: 54544 - protein, 255 aa, Homo sapiens
MDVMDGCQFSPSEYFYDGSCIPSPEGEFGDEFVPRVAAFGAHKAELQGSDEDEHVRAPTGHHQAGHCLMWACKACKRKSTTMDRRKAATMRERRRLKKVNQAFETLKRCTTTNPNQRLPKVEILRNAIRYIESLQELLREQVENYYSLPGQSCSEPTSPTSNCSDGMPECNSPVWSRKSSTFDSIYCPDVSNVYATDKNSLSSLDCLSNIVDRITSSEQPGLPLQDLASLSPVASTDSQPATPGASSSRLIYHVL

SEQ ID NO: 54545 - protein, 242 aa, Homo sapiens
MMMDLFETGSYFFYLDGENVTLQPLEVAEGSPLYPGSDGTLSPCQDQMPPEAGSDSSGEEHVLAPPGLQPPHCPGQCLIWACKTCKRKSAPTDRRKAATLRERRRLKKINEAFEALKRRTVANPNQRLPKVEILRSAISYIERLQDLLHRLDQQEKMQELGVDPFSYRPKQENLEGADFLRTCSSQWPSVSDHSRGLVITAKEGGASIDSSASSSLRCLSSIVDSISSEERKLPCVEEVVEK

SEQ ID NO: 54546 - protein, 224 aa, Homo sapiens
MELYETSPYFYQEPRFYDGENYLPVHLQGFEPPGYERTELTLSPEAPGPLEDKGLGTPEHCPGQCLPWACKVCKRKSVSVDRRRAATLREKRRLKKVNEAFEALKRSTLLNPNQRLPKVEILRSAIQYIERLQALLSSLNQEERDLRYRGGGGPQPGVPSECSSHSASCSPEWGSALEFSANPGDHLLTADPTDAHNLHSLTSIVDSITVEDVSVAFPDETMPN

SEQ ID NO: 54547 - protein, 154 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDMASNYKELGFQG

SEQ ID NO: 54548 - protein, 154 aa, Homo sapiens; identical to SEQ ID NO: 54547

SEQ ID NO: 54549 - protein, 154 aa, Homo sapiens; identical to SEQ ID NO: 54547

SEQ ID NO: 54550 - protein, 154 aa, Homo sapiens; identical to SEQ ID NO: 54547

SEQ ID NO: 54551 - protein, 77 aa, Homo sapiens
MGLSDGEWQLVLNVWGKVEADIPGHGQEVLIRLFKGHPETLEKFDKFKHLKSEDEMKASEDLKKHGATVLTALGGIL

SEQ ID NO: 54552 - protein, 143 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLEFISECIIQVLQSKHPGDFGADAQGAMNKALELFRKDM

SEQ ID NO: 54553 - protein, 106 aa, Homo sapiens
MGLSDGEWQLVLNVWGKVEADIPGHGQEVLIRLFKGHPETLEKFDKFKHLKSEDEMKASEDLKKHGATVLTALGGILKKKGHHEAEIKPLAQSHATKHKIPVKYLE

SEQ ID NO: 54554 - protein, 106 aa, Homo sapiens; identical to SEQ ID NO: 54553

SEQ ID NO: 54555 - protein, 136 aa, Homo sapiens [sequence omitted]

SEQ ID NO: 54556 - protein, 1465 aa, Homo sapiens
MSLVTVPFYQKRHRHFDQSYRNIQTRYLLDEYASKKRASTQASSQKSLSQRSSSQRASSQTSLGGTICRVCAKRVSTQEDEEQENRSRYQSLVAAYGEAKRQRFLSELAHLEEDVHLARSQARDKLDKYAIQQMMEDKLAWERHTFEERISRAPEILVRLRSHTVWERMSVKLCFTVQGFPTPVVQWYKDGSLICQAAEPGKYRIESNYGVHTLEINRADFDDTATYSAVATNAHGQVSTNAAVVVRRFRGDEEPFRSVGLPIGLPLSSMIPYTHFDVQFLEKFGVTFRREGETVTLKCTMLVTPDLKRVQPRAEWYRDDVLLKESKWTKMFFGEGQASLSFSHLHKDDEGLYTLRIVSRGGVSDHSAFLFVRDADPLVTGAPGAPMDLQCHDANRDYVIVTWKPPNTTTESPVMGYFVDRCEVGTNNWVQCNDAPVKICKYPVTGLFEGRSYIFRVRAVNSAGISRPSRVSDAVAALDPLDLRRLQAVHLEGEKEIAIYQDDLEGDAQVPGPPTGVHASEISRNYVVLSWEPPTPRGKDPLMYFIEKSVVGSGSWQRVNAQTAVRSPRYAVFDLMEGKSYVFRVLSANRHGLSEPSEITSPIQAQDVTVVPSAPGRVLASRNTKTSVVVQWDRPKHEEDLLGYYVDCCVAGTNLWEPCNHKPIGYNRFVVHGLTTGEQYIFRVKAVNAVGMSENSQESDVIKVQAALTVPSHPYGITLLNCDGHSMTLGWKVPKFSGGSPILGYYLDKREVHHKNWHEVNSSPSKPTILTVDGLTEGSLYEFKIAAVNLAGIGEPSDPSEHFKCEAWTMPEPGPAYDLTFCEVRDTSLVMLWKAPVYSGSSPVSGYFVDFREEDAGEWITVNQTTTANRYLKVSDLQQGKTYVFRVRAVNANGVGKPSDTSEPVLVEARPGTKEISAGVDEQGNIYLGFDCQEMTDASQFTWCKSYEEISDDERFKIETVGDHSKLYLKNPDKEDLGTYSVSVSDTDGVSSSFVLDPEELERLMALSNEIKNPTIPLKSELAYEIFDKGRVRFWLQAEHLSPDASYRFIINDREVSDSEIHRIKCDKATGIIEMVMDRFSIENEGTYTVQIHDGKAKSQSSLVLIGDAFKTVLEEAEFQRKEFLRKQGPHFAEYLHWDVTEECEVRLVCKVANTKKETVFKWLKDDVLYETETLPNLERGICELLIPKLSKKDHGEYKATLKDDRGQDVSILEIAGKVYDDMILAMSRVCGKSASPLKVLCTPEGIRLQCFMKYFTDEMKVNWCHKDAKISSSEHMRIGGSEEMAWLQICEPTEKDKGKYTFEIFDGKDNHQRSLDLSGQAFDEAFAEFQQFKAAAFAEKNRGRLIGGLPDVVTIMEGKTLNLTCTVFGNPDPEVIWFKNDQDIQLSEHFSVKVEQAKYVSMTIKGVTSEDSGKYSINIKNKYGGEKIDVTVSVYKHGEKIPDMAPPQQAKPKLIPASASAAGQ

SEQ ID NO: 54557 - protein, 1139 aa, Homo sapiens
MPEPTKKEDEEEVSPPSALPPDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKGGLSFCRLLLQGVPPNIIDSYLRDLHSSNPEEY

SEQ ID NO: 54558 - protein, 1173 aa, Homo sapiens
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQVGSPSADSSCKAYLQT

SEQ ID NO: 54559 - protein, 1127 aa, Homo sapiens
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54560 - protein, 1120 aa, Homo sapiens
MPEPTKKEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54561 - protein, 1132 aa, Homo sapiens
MPEPTKKEENEVPAPAPPPEDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54562 - protein, 1273 aa, Homo sapiens [sequence omitted]

SEQ ID NO: 54563 - protein, 1274 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKSSSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 54564 - protein, 1274 aa, Homo sapiens
MPEPGKKPVSAFSKKPRSVEVAAGSPAVFEAETERAGVKVRWQRGGSDISASNKYGLATEGTRHTLTVREVGPADQGSYAVIAGSSKVKFDLKVIEAEKAEPMLAPAPAPAEATGAPGEAPAPAAELGESAPSPKGSSSAALNGPTPGAPDDPIGLFVMRPQDGEVTVGGSITFSARVAGASLLKPPVVKWFKGKWVDLSSKVGQHLQLHDSYDRASKVYLFELHITDAQPAFTGSYRCEVSTKDKFDCSNFNLTVHEAMGTGDLDLLSAFRRTSLAGGGRRISDSHEDTGILDFSSLLKKRDSFRTPRDSKLEAPAEEDVWEILRQAPPSEYERIAFQYGVTDLRGMLKRLKGMRRDEKKSTAFQKKLEPAYQVSKGHKIRLTVELADHDAEVKWLKNGQEIQMSGSKYIFESIGAKRTLTISQCSLADDAAYQCVVGGEKCSTELFVKEPPVLITRPLEDQLVMVGQRVEFECEVSEEGAQVKWLKDGVELTREETFKYRFKKDGQRHHLIINEAMLEDAGHYALCTSGGQALAELIVQEKKLEVYQSIADLMVGAKDQAVFKCEVSDENVRGVWLKNGKELVPDSRIKVSHIGRVHKLTIDDVTPADEADYSFVPEGFACNLSAKLHFMEVKIDFVPRQEPPKIHLDCPGRIPDTIVVVAGNKLRLDVPISGDPAPTVIWQKAITQGNKAPARPAPDAPEDTGDSDEWVFDKKLLCETEGRVRVETTKDRSIFTVEGAEKEDEGVYTVTVKNPVGEDQVNLTVKVIDVPDAPAAPKISNVGEDSCTVQWEPPAYDGGQPILGYILERKKKKSYRWMRLNFDLIQELSHEARRMIEGVVYEMRVYAVNAIGMSRPSPASQPFMPIGPPSEPTHLAVEDVSDTTVSLKWRPPERVGAGGLDGYSVEYCPEGCSEWVAALQGLTEHTSILVKDLPTGARLLFRVRAHNMAGPGAPVTTTEPVTVQEILQRPRLQLPRHLRQTIQKKVGEPVNLLIPFQGKPRPQVTWTKEGQPLAGEEVSIRNSPTDTILFIRAARRVHSGTYQVTVRIENMEDKATLVLQVVDKPSPPQDLRVTDAWGLNVALEWKPPQDVGNTELWGYTVQKADKKTMEWFTVLEHYRRTHCVVPELIIGNGYYFRVFSQNMVGFSDRAATTKEPVFIPRPGITYEPPNYKALDFSEAPSFTQPLVNRSVIAGYTAMLCCAVRGSPKPKISWFKNGLDLGEDARFRMFSKQGVLTLEIRKPCPFDGGIYVCRATNLQGEARCECRLEVRVPQ

SEQ ID NO: 54565 - protein, 1141 aa, Homo sapiens
MPEAKPAAKKAPKGKDAPKGAPKEAPPKEAPAEAPKEAPPEDQSPTAEEPTGVFLKKPDSVSVETGKDAVVVAKVNGKELPDKPTIKWFKGKWLELGSKSGARFSFKESHNSASNVYTVELHIGKVVLGDRGYYRLEVKAKDTCDSCGFNIDVEAPRQDASGQSLESFKRTSEKKSDTAGELDFSGLLKKREVVEEEKKKKKKDDDDLGIPPEIWELLKGAKKSEYEKIAFQYGITDLRGMLKRLKKAKVEVKKSAAFTKKLDPAYQVDRGNKIKLMVEISDPDLTLKWFKNGQEIKPSSKYVFENVGKKRILTINKCTLADDAAYEVAVKDEKCFTELFVKEPPVLIVTPLEDQQVFVGDRVEMAVEVSEEGAQVMWMKDGVELTREDSFKARYRFKKDGKRHILIFSDVVQEDRGRYQVITNGGQCEAELIVEEKQLEVLQDIADLTVKASEQAVFKCEVSDEKVTGKWYKNGVEVRPSKRITISHVGRFHKLVIDDVRPEDEGDYTFVPDGYALSLSAKLNFLEIKVEYVPKQEPPKIHLDCSGKTSENAIVVVAGNKLRLDVSITGEPPPVATWLKGDEVFTTTEGRTRIEKRVDCSSFVIESAQREDEGRYTIKVTNPVGEDVASIFLQVVDVPDPPEAVRITSVGEDWAILVWEPPMYDGGKPVTGYLVERKKKGSQRWMKLNFEVFTETTYESTKMIEGILYEMRVFAVNAIGVSQPSMNTKPFMPIAPTSEPLHLIVEDVTDTTTTLKWRPPNRIGAGGIDGYLVEYCLEGSEEWVPANTEPVERCGFTVKNLPTGARILFRVVGVNIAGRSEPATLAQPVTIREIAEPPKIRLPRHLRQTYIRKVGEQLNLVVPFQGKPRPQVVWTKGGAPLDTSRVHVRTSDFDTVFFVRQAARSDSGEYELSVQIENMKDTATIRIRVVEKAGPPINVMVKEVWGTNALVEWQAPKDDGNSEIMGYFVQKADKKTMEWFNVYERNRHTSCTVSDLIVGNEYYFRVYTENICGLSDSPGVSKNTARILKTGITFKPFEYKEHDFRMAPKFLTPLIDRVVVAGYSAALNCAVRGHPKPKVVWMKNKMEIREDPKFLITNYQGVLTLNIRRPSPFDAGTYTCRAVNELGEALAECKLEVRVPQ

SEQ ID NO: 54566 - protein, 1141 aa, Homo sapiens
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54567 - protein, 1171 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54568 - protein, 1148 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54569 - protein, 1164 aa, Homo sapiens
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGSTSAKQSDENGEAAYDLPAEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIYQGVNTPGQPVFLEGQQQSLHNKDF

SEQ ID NO: 54570 - protein, 782 aa, Homo sapiens
MPEPTKKEENEVPAPAPPPEEPSKEKEAGTTPAKDEEEVSPPSALPPGLGSRALERKDSDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPRPHWCSRFRWLCARVLL

SEQ ID NO: 54571 - protein, 1141 aa, Homo sapiens; identical to SEQ ID NO: 54566

SEQ ID NO: 54572 - protein, 1123 aa, Homo sapiens
MPEPTKKEENEVPAPAPPPEEPSKEKEAGTTPAKDWTLVETPPGEEQAKQNANSQLSILFIEKPQGGTVKVGEDITFIAKVKAEDLLRKPTIKWFKGKWMDLASKAGKHLQLKETFERHSRVYTFEMQIIKAKDNFAGNYRCEVTYKDKFDSCSFDLEVHESTGTTPNIDIRSAFKRSGEGQEDAGELDFSGLLKRREVKQQEEEPQVDVWELLKNAKPSEYEKIAFQYGITDLRGMLKRLKRMRREEKKSAAFAKILDPAYQVDKGGRVRFVVELADPKLEVKWYKNGQEIRPSTKYIFEHKGCQRILFINNCQMTDDSEYYVTAGDEKCSTELFVREPPIMVTKQLEDTTAYCGERVELECEVSEDDANVKWFKNGEEIIPGPKSRYRIRVEGKKHILIIEGATKADAAEYSVMTTGGQSSAKLSVDLKPLKILTPLTDQTVNLGKEICLKCEISENIPGKWTKNGLPVQESDRLKVVHKGRIHKLVIANALTEDEGDYVFAPDAYNVTLPAKVHVIDPPKIILDGLDADNTVTVIAGNKLRLEIPISGEPPPKAMWSRGDKAIMEGSGRIRTESYPDSSTLVIDIAERDDSGVYHINLKNEAGEAHASIKVKVVDFPDPPVAPTVTEVGDDWCIMNWEPPAYDGGSPILGYFIERKKKQSSRWMRLNFDLCKETTFEPKKMIEGVAYEVRIFAVNAIGISKPSMPSRPFVPLAVTSPPTLLTVDSVTDTTVTMRWRPPDHIGAAGLDGYVLEYCFEGTEDWIVANKDLIDKTKFTITGLPTDAKIFVRVKAVNAAGASEPKYYSQPILVKEIIEPPKIRIPRHLKQTYIRRVGEAVNLVIPFQGKPRPELTWKKDGAEIDKNQINIRNSETDTIIFIRKAERSHSGKYDLQVKVDKFVETASIDIQIIDRPGPPQIVKIEDVWGENVALTWTPPKDDGNAAITGYTIQKADKKSMEWFTVIEHYHRTSATITELVIGNEYYFRVFSENMCGLSEDATMTKESAVIARDGKIYKNPVYEDFDFSEAPMFTQPLVNTYAIAGYNATLNCSVRGNPKPKITWMKNKVAIVDDPRYRMFSNQGVCTLEIRKPSPYDGGTYCCKAVNDLGTVEIECKLEVKVIAQ

SEQ ID NO: 54573 - protein, 477 aa, Homo sapiens
MMEKNTSEGPACSPEETASESAKVPTAEPPGEVAVSESTREEQVPKPQAPAPQAPTASTATKPAPPSEDVPSAPLLLTLDDVSSSSVTVSWEPPERLGRLGLQGYVLELCREGASEWVPVSARPMMVTQQTVRNLALGDKFLLRVSAVSSAGAGPPAMLDQPIHIRENIEAPKIRVPRHLRQTYIRQVGETVNLQIPFQGKPKPQATWTHNGHALDSQRVSMRTGDQDSILFIRSAQRSDSGRYELTVRVEDLEAKAVIDILVIEKPGPPSSIRLLDVWGCNAALQWTPPQDTGNTELLGYMVQKADKKTGQWFTVLERYHPTTCTISDLIIGNSYSFRVFSENLCGLSTSATVTKELAHIQKADIAAKPKGFIERDFSEAPSFTQPLADHTSTPGYSTQLFCSVRASPKPKIIWMKNKMEIQGNPKYRALSEQGVCTLEIRKPSPFDSGVYTCKAINVLGEASVDCRLEVKASAAH

SEQ ID NO: 54574 - protein, 1938 aa, Homo sapiens
MSSDAEMAIFGEAAPYLRKPEKERIEAQNRPFDSKKACFVADNKEMYVKGMIQTRENDKVIVKTLDDRMLTLNNDQVFPMNPPKFDKIEDMAMMTHLHEPAVLYNLKERYAAWMIYTYSGLFCVTVNPYKWLPVYKPEVVAAYRGKKRQEAPPHIFSISDNAYQFMLTDRDNQSILITGESGAGKTVNTKRVIQYFATIAVTGDKKKETQPGKMQGTLEDQIIQANPLLEAFGNAKTVRNDNSSRFGKFIRIHFGATGKLASADIETYLLEKSRVTFQLSSERSYHIFYQIMSNKKPELIDLLLISTNPFDFPFVSQGEVTVASIDDSEELLATDNAIDILGFSSEEKVGIYKLTGAVMHYGNMKFKQKQREEQAEPDGTEVADKAGYLMGLNSAEMLKGLCCPRVKVGNEYVTKGQNVQQVTNSVGALAKAVYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYDQHLGKSNNFQKPKPAKGKAEAHFSLVHYAGTVDYNIAGWLDKNKDPLNETVVGLYQKSSLKLLSFLFSNYAGAETGDSGGSKKGGKKKGSSFQTVSAVFRENLNKLMTNLRSTHPHFVRCLIPNETKTPGVMDHYLVMHQLRCNGVLEGIRICRKGFPSRILYADFKQRYRILNASAIPEGQFIDSKNASEKLLNSIDVDREQFRFGNTKVFFKAGLLGLLEEMRDEKLVTLMTSTQAVCRGYLMRVEFKKMMERRDSIFCIQYNIRSFMNVKHWPWMNLFFKIKPLLKSAEAEKEMATMKEDFERTKEELARSEARRKELEEKMVSLLQEKNDLQLQVQSETENLMDAEERCEGLIKSKILLEAKVKELTERLEEEEEMNSELVAKKRNLEDKCSSLKRDIDDLELTLTKVEKEKHATENKVKNLSEEMTALEENISKLTKEKKSLQEAHQQTLDDLQVEEDKVNGLIKINAKLEQQTDDLEGSLEQEKKLRADLERAKRKLEGDLKMSQESIMDLENDKQQIEEKLKKKEFELSQLQAKIDDEQVHSLQFQKKIKELQARIEELEEEIEAEHTLRAKIEKQRSDLARELEEISERLEEASGATSAQIEMNKKREAEFQKMRRDLEEATLQHEATAATLRKKQADSVAELGEQIDNLQRVKQKLEKEKSELKMEIDDMASNIEALSKSKSNIERTCRTVEDQFSEIKAKDEQQTQLIHDLNMQKARLQTQNGELSHRVEEKESLISQLTKSKQALTQQLEELKRQMEEETKAKNAMAHALQSSRHDCDLLREQYEEEQEAKAELQRALSKANSEVAQWRTKYETDAIQRTEELEEAKKKLAQRLQEAEENTETANSKCASLEKTKQRLQGEVEDLMRDLERSHTACATLDKKQRNFDKVLAEWKQKLDESQAELEAAQKESRSLSTELFKMRNAYEEVVDQLETLRRENKNLQEEISDLTEQIAETGKNLQEAEKTKKLVEQEKSDLQVALEEVEGSLEHEESKILRVQLELSQVKSELDRKVIEKDEEIEQLKRNSQRAAEALQSVLDAEIRSRNDALRLKKKMEGDLNEMEIQLGHSNRQMAETQKHLRTVQGQLKDSQLHLDDALRSNEDLKEQLAIVERRNGLLLEELEEMKVALEQTERTRRLSEQELLDASDRVQLLHSQNTSLINTKKKLEADIAQCQAEVENSIQESRNAEEKAKKAITDAAMMAEELKKEQDTSAHLERMKKNLEQTVKDLQHRLDEAEQLALKGGKKQIQKLENRVRELENELDVEQKRGAEALKGAHKYERKVKEMTYQAEEDHKNILRLQDLVDKLQAKVKSYKRQAEEAEEQANTQLSRCRRVQHELEEAAERADIAESQVNKLRAKSRDVGSQKMEE

SEQ ID NO: 54575 - protein, 2036 aa, Homo sapiens
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDEHGGFQQFSFLGSFPPSPPGSAERCSSAISPPGVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54576 - protein, 1940 aa, Homo sapiens
MSSDTEMEVFGIAAPFLRKSEKERIEAQNQPFDAKTYCFVVDSKEEYAKGKIKSSQDGKVTVETEDNRTLVVKPEDVYAMNPPKFDRIEDMAMLTHLNEPAVLYNLKDRYTSWMIYTYSGLFCVTVNPYKWLPVYNPEVVEGYRGKKRQEAPPHIFSISDNAYQFMLTDRENQSILITGESGAGKTVNTKRVIQYFATIAATGDLAKKKDSKMKGTLEDQIISANPLLEAFGNAKTVRNDNSSRFGKFIRIHFGTTGKLASADIETYLLEKSRVTFQLKAERSYHIFYQILSNKKPELIELLLITTNPYDYPFISQGEILVASIDDAEELLATDSAIDILGFTPEEKSGLYKLTGAVMHYGNMKFKQKQREEQAEPDGTEVADKTAYLMGLNSSDLLKALCFPRVKVGNEYVTKGQTVDQVHHAVNALSKSVYEKLFLWMVTRINQQLDTKLPRQHFIGVLDIAGFEIFEYNSLEQLCINFTNEKLQQFFNHHMFVLEQEEYKKEGIEWTFIDFGMDLAACIELIEKPMGIFSILEEECMFPKATDTSFKNKLYDQHLGKSNNFQKPKVVKGRAEAHFSLIHYAGTVDYSVSGWLEKNKDPLNETVVGLYQKSSNRLLAHLYATFATADADSGKKKVAKKKGSSFQTVSALFRENLNKLMSNLRTTHPHFVRCIIPNETKTPGAMEHSLVLHQLRCNGVLEGIRICRKGFPNRILYGDFKQRYRVLNASAIPEGQFIDSKKACEKLLASIDIDHTQYKFGHTKVFFKAGLLGTLEEMRDDRLAKLITRTQAVCRGFLMRVEFQKMVQRRESIFCIQYNIRSFMNVKHWPWMKLFFKIKPLLKSAETEKEMATMKEEFQKTKDELAKSEAKRKELEEKLVTLVQEKNDLQLQVQAESENLLDAEERCDQLIKAKFQLEAKIKEVTERAEDEEEINAELTAKKRKLEDECSELKKDIDDLELTLAKVEKEKHATENKVKNLTEELSGLDETIAKLTREKKALQEAHQQALDDLQAEEDKVNSLNKTKSKLEQQVEDLESSLEQEKKLRVDLERNKRKLEGDLKLAQESILDLENDKQQLDERLKKKDFEYCQLQSKVEDEQTLGLQFQKKIKELQARIEELEEEIEAERATRAKTEKQRSDYARELEELSERLEEAGGVTSTQIELNKKREAEFLKLRRDLEEATLQHEAMVAALRKKHADSVAELGEQIDNLQRVKQKLEKEKSEFKLEIDDLSSSMESVSKSKANLEKICRTLEDQLSEARGKNEEIQRSLSELTTQKSRLQTEAGELSRQLEEKESIVSQLSRSKQAFTQQTEELKRQLEEENKAKNALAHALQSSRHDCDLLREQYEEEQEGKAELQRALSKANSEVAQWRTKYETDAIQRTEELEEAKKKLAQRLQDSEEQVEAVNAKCASLEKTKQRLQGEVEDLMVDVERANSLAAALDKKQRNFDKVLAEWKTKCEESQAELEASLKESRSLSTELFKLKNAYEEALDQLETVKRENKNLEQEIADLTEQIAENGKTIHELEKSRKQIELEKADIQLALEEAEAALEHEEAKILRIQLELTQVKSEIDRKIAEKDEEIEQLKRNYQRTVETMQSALDAEVRSRNEAIRLKKKMEGDLNEIEIQLSHANRQAAETLKHLRSVQGQLKDTQLHLDDALRGQEDLKEQLAIVERRANLLQAEVEELRATLEQTERARKLAEQELLDSNERVQLLHTQNTSLIHTKKKLETDLMQLQSEVEDASRDARNAEEKAKKAITDAAMMAEELKKEQDTSAHLERMKKNLEQTVKDLQHRLDEAEQLALKGGKKQIQKLETRIRELEFELEGEQKKNTESVKGLRKYERRVKELTYQSEEDRKNVLRLQDLVDKLQVKVKSYKRQAEEADEQANAHLTKFRKAQHELEEAEERADIAESQVNKLRAKTRDFTSSRMVVHESEE

SEQ ID NO: 54577 - protein, 1043 aa, Homo sapiens
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQCILITGESGSGKTEASKLVMSYVAAVCGKGEQVNSVKEQLLQSNPVLEAFGNAKTIRNNNSSRFGKYMDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 54578 - protein, 96 aa, Homo sapiens
MPLLEGSVGVEDLVLLEPLVEESLLKNLQLRYENKEIYTYIGNVVISVNPYQQLPIYGPEFIAKYQDYTFYELKPHIYALANVAYQSLRDRDRDQC

SEQ ID NO: 54579 - protein, 1043 aa, Homo sapiens; identical to SEQ ID NO: 54577

SEQ ID NO: 54580 - protein, 881 aa, Homo sapiens
MDIEFDFKGSPLGGVITNYLLEKSRLVKQLKGERNFHIFYQLLAGADEQLLKALKLERDTTGYAYLNHEVSRVDGMDDASSFRAVQSAMAVIGFSEEEIRQVLEVTSMVLKLGNVLVADEFQASGIPASGIRDGRGVREIGEMVGLNSEEVERALCSRTMETAKEKVVTALNVMQAQYARDALAKNIYSRLFDWIVNRINESIKVGIGEKKKVMGVLDIYGFEILEDNSFEQFVINYCNEKLQQVFIEMTLKEEQEEYKREGIPWTKVDYFDNGIICKLIEHNQRGILAMLDEECLRPGVVSDSTFLAKLNQLFSKHGHYESKVTQNAQRQYDHTMGLSCFRICHYAGKVTYNVTSFIDKNNDLLFRDLLQAMWKAQHPLLRSLFPEGNPKQASLKRPPTAGAQFKSSVAILMKNLYSKSPNYIRCIKPNEHQQRGQFSSDLVATQARYLGLLENVRVRRAGYAHRQGYGPFLERYRLLSRSTWPHWNGGDREGVEKVLGELSMSSGELAFGKTKIFIRSPKTLFYLEEQRRLRLQQLATLIQKIYRGWRCRTHYQLMRKSQILISSWFRGNMQKKCYGKIKASVLLIQAFVRGWKARKNYRKYFRSEAALTLADFIYKSMVQKFLLGLKNNLPSTNVLDKTWPAAPYKCLSTANQELQQLFYQWKCKRFRDQLSPKQVEILREKLCASELFKGKKASYPQSVPIPFCGDYIGLQGNPKLQKLKGGEEGPVLMAEAVKKVNRGNGKTSSRILLLTKGHVILTDTKKSQAKIVIGLDNVAGVSVTSLKDGLFSLHLSEMSSVGSKGDFLLVSEHVIELLTKMYRAVLDATQRQLTVTVTEKFSVRFKENSVAVKVVQGPAGGDNSKLRYKKKGSHCLEVTVQ

SEQ ID NO: 54581 - protein, 1136 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELRRLKEEARNKHAIAVIWAYWLGSKARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 54582 - protein, 1078 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 54583 - protein, 1107 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNELKEICELTGIDQSVLERAFSFRTVEAKQEKVSTTLNVAQAYYARDALAKNLYSRLFSWLVNRINESIKAQTKVRKKVMGVLDIYGFEIFEDNSFEQFIINYCNEKLQQIFIELTLKEEQEEYIREDIEWTHIDYFNNAIICDLIENNTNGILAMLDEECLRPGTVTDETFLEKLNQVCATHQHFESRMSKCSRFLNDTSLPHSCFRIQHYAGKVLYQVEGFVDKNNDLLYRDLSQAMWKASHALIKSLFPEGNPAKINLKRPPTAGSQFKASVATLMKNLQTKNPNYIRCIKPNDKKAAHIFNEALVCHQIRYLGLLENVRVRRAGYAFRQAYEPCLERYKMLCKQTWPHWKGPARSGVEVLFNELEIPVEEYSFGRSKIFIRNPRTLFKLEDLRKQRLEDLATLIQKIYRGWKCRTHFLLMKKSQIVIAAWYRRYAQQKRYQQTKSSALVIQSYIRGWKARKILRELKHQKRCKEAVTTIAAYWHGTQARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 54584 - protein, 1136 aa, Homo sapiens; identical to SEQ ID NO: 54581

SEQ ID NO: 54585 - protein, 163 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNS

SEQ ID NO: 54586 - protein, 83 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPH

SEQ ID NO: 54587 - protein, 149 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVL

SEQ ID NO: 54588 - protein, 381 aa, Homo sapiens
MKKSQIVIAAWYRRYAQQKRYQQTKSSALVIQSYIRGWKARKILRELKHQKRCKEAVTTIAAYWHGTQARRELKRLKEEARRKHAVAVIWAYWLGLKVRREYRKFFRANAGKKIYEFTLQRIVQKYFLEMKNKMPSLSPIDKNWPSRPYLFLDSTHKELKRIFHLWRCKKYRDQFTDQQKLIYEEKLEASELFKDKKALYPSSVGQPFQGAYLEINKNPKYKKLKDAIEEKIIIAEVVNKINRANGKSTSRIFLLTNNNLLLADQKSGQIKSEVPLVDVTKVSMSSQNDGFFAVHLKEGSEAASKGDFLFSSDHLIEMATKLYRTTLSQTKQKLNIEISDEFLVQFRQDKVCVKFIQGNQKNGSVPTCKRKNNRLLEVAVP

SEQ ID NO: 54589 - protein, 307 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDKNESK

SEQ ID NO: 54590 - protein, 303 aa, Homo sapiens
MAKMEVKTSLLDNMIGVGDMVLLEPLNEETFINNLKKRFDHSEIYTYIGSVVISVNPYRSLPIYSPEKVEEYRNRNFYELSPHIFALSDEAYRSLRDQDKDQCILITGESGAGKTEASKLVMSYVAAVCGKGAEVNQVKEQLLQSNPVLEAFGNAKTVRNDNSSRFGKYMDIEFDFKGDPLGGVISNYLLEKSRVVKQPRGERNFHVFYQLLSGASEELLNKLKLERDFSRYNYLSLDSAKVNGVDDAANFRTVRNAMQIVGFMDHEAESVLAVVAAVLKLGNIEFKPESRVNGLDESKIKDK

SEQ ID NO: 54591 - protein, 1063 aa, Homo sapiens
MALQVELVPTGEIIRVVHPHRPCKLALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54592 - protein, 1028 aa, Homo sapiens
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54593 - protein, 1044 aa, Homo sapiens
MRYRASALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54594 - protein, 805 aa, Homo sapiens
MESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKEVGGTDHPAAHPRLRPAPRPPLPRERLLPGPCAHLFFAKPEAAAAPECPGHLVAHAPTCPA

SEQ ID NO: 54595 - protein, 1044 aa, Homo sapiens
MRGRASALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54596 - protein, 1039 aa, Homo sapiens
MALGSDGVRVTMESALTARDRVGVQDFVLLENFTSEAAFIENLRRRFRENLIYTYIGPVLVSVNPYRDLQIYSRQHMERYRGVSFYEVPPHLFAVADTVYRALRTERRDQAVMISGESGAGKTEATKRLLQFYAETCPAPERGGAVRDRLLQSNPVLEAFGNAKTLRNDNSSRFGKYMDVQFDFKGAPVGGHILSYLLEKSRVVHQNHGERNFHIFYQLLEGGEEETLRRLGLERNPQSYLYLVKGQCAKVSSINDKSDWKVVRKALTVIDFTEDEVEDLLSIVASVLHLGNIHFAANEESNAQVTTENQLKYLTRLLSVEGSTLREALTHRKIIAKGEELLSPLNLEQAAYARDALAKAVYSRTFTWLVGKINRSLASKDVESPSWRSTTVLGLLDIYGFEVFQHNSFEQFCINYCNEKLQQLFIELTLKSEQEEYEAEGIAWEPVQYFNNKIICDLVEEKFKGIISILDEECLRPGEATDLTFLEKLEDTVKHHPHFLTHKLADQRTRKSLGRGEFRLLHYAGEVTYSVTGFLDKNNDLLFRNLKETMCSSKNPIMSQCFDRSELSDKKRPETVATQFKMSLLQLVEILQSKEPAYVRCIKPNDAKQPGRFDEVLIRHQVKYLGLLENLRVRRAGFAYRRKYEAFLQRYKSLCPETWPTWAGRPQDGVAVLVRHLGYKPEEYKMGRTKIFIRFPKTLFATEDALEVRRQSLATKIQAAWRGFHWRQKFLRVKRSAICIQSWWRGTLGRRKAAKRKWAAQTIRRLIRGFVLRHAPRCPENAFFLDHVRTSFLLNLRRQLPQNVLDTSWPTPPPALREASELLRELCIKNMVWKYCRSISPEWKQQLQQKAVASEIFKGKKDNYPQSVPRLFISTRLGTDEISPRVLQALGSEPIQYAVPVVKYDRKGYKPRSRQLLLTPNAVVIVEDAKVKQRIDYANLTGISVSSLSDSLFVLHVQRADNKQKGDVVLQSDHVIETLTKTALSANRVNSININQGSITFAGGPGRDGTIDFTPGSELLITKAKNGHLAVVAPRLNSR

SEQ ID NO: 54597 - protein, 1006 aa, Homo sapiens
MAEQESLEFGKADFVLMDTVSMPEFMANLRLRFEKGRIYTFIGEVVVSVNPYKLLNIYGRDTIEQYKGRELYERPPHLFAIADAAYKAMKRRSKDTCIVISGESGAGKTEASKYIMQYIAAITNPSQRAEVERVKNMLLKSNCVLEAFGNAKTNRNDNSSRFGKYMDINFDFKGDPIGGHINNYLLEKSRVIVQQPGERSFHSFYQLLQGGSEQMLRSLHLQKSLSSYNYIHVGAQLKSSINDAAEFRVVADAMKVIGFKPEEIQTVYKILAAILHLGNLKFVVDGDTPLIENGKVVSIIAELLSTKTDMVEKALLYRTVATGRDIIDKQHTEQEASYGRDAFAKAIYERLFCWIVTRINDIIEVKNYDTTIHGKNTVIGVLDIYGFEIFDNNSFEQFCINYCNEKLQQLFIQLVLKQEQEEYQREGIPWKHIDYFNNQIIVDLVEQQHKGIIAILDDACMNVGKVTDEMFLEALNSKLGKHAHFSSRKLCASDKILEFDRDFRIRHYAGDVVYSVIGFIDKNKDTLFQDFKRLMYNSSNPVLKNMWPEGKLSITEVTKRPLTAATLFKNSMIALVDNLASKEPYYVRCIKPNDKKSPQIFDDERCRHQVEYLGLLENVRVRRAGFAFRQTYEKFLHRYKMISEFTWPNHDLPSDKEAVKKLIERCGFQDDVAYGKTKIFIRTPRTLFTLEELRAQMLIRIVLFLQKVWRGTLARMRYKRTKAALTIIRYYRRYKVKSYIHEVARRFHGVKTMRDYGKHVKWPSPPKVLRRFEEALQTIFNRWRASQLIKSIPASDLPQVRAKVAAVEMLKGQRADLGLQRAWEGNYLASKPDTPQTSGTFVPVANELKRKDKYMNVLFSCHVRKVNRFSKVEDRAIFVTDRHLYKMDPTKQYKVMKTIPLYNLTGLSVSNGKDQLVVFHTKDNKDLIVCLFSKQPTHESRIGELVGVLVNHFKSEKRHLQVNVTNPVQCSLHGKKCTVSVETRLNQPQPDFTKNRSGFILSVPGN

SEQ ID NO: 54598 - protein, 198 aa, Homo sapiens [sequence omitted]

SEQ ID NO: 54599 - protein, 1108 aa, Homo sapiens
MGSKGVYQYHWQSHNVKHSGVDDMVLLSKITENSIVENLKKRYMDDYIFTYIGSVLISVNPFKQMPYFGEKEIEMYQGAAQYENPPHIYALADNMYRNMIIDRENQCVIISGESGAGKTVAAKYIMSYISRVSGGGTKVQHVKDIILQSNPLLEAFGNAKTVRNNNSSRFGKYFEIQFSPGGEPDGGKISNFLLEKSRVVMRNPGERSFHIFYQLIEGASAEQKHSLGITSMDYYYYLSLSGSYKVDDIDDRREFQETLHAMNVIGIFAEEQTLVLQIVAGILHLGNISFKEVGNYAAVESEEFLAFPAYLLGINQDRLKEKLTSRQMDSKWGGKSESIHVTLNVEQACYTRDALAKALHARVFDFLVDSINKAMEKDHEEYNIGVLDIYGFEIFQKNGFEQFCINFVNEKLQQIFIELTLKAEQEEYVQEGIRWTPIEYFNNKIVCDLIENKVNPPGIMSILDDVCATMHAVGEGADQTLLQKLQMQIGSHEHFNSWNQGFIIHHYAGKVSYDMDGFCERNRDVLFMDLIELMQSSELPFIKSLFPENLQADKKGRPTTAGSKIKKQANDLVSTLMKCTPHYIRCIKPNETKKPRDWEESRVKHQVEYLGLKENIRVRRAGYAYRRIFQKFLQRYAILTKATWPSWQGEEKQGVLHLLQSVNMDSDQFQLGRSKVFIKAPESLFLLEEMRERKYDGYARVIQKSWRKFVARKKYVQMREEASDLLLNKKERRRNSINRNFIGDYIGMEEHPELQQFVGKREKIDFADTVTKYDRRFKGVKRDLLLTPKCLYLIGREKVKQGPDKGLVKEVLKRKIEIERILSVSLSTMQDDIFILHEQEYDSLLESVFKTEFLSLLAKRYEEKTQKQLPLKFSNTLELKLKKENWGPWSAGGSRQVQFHQGFGDLAVLKPSNKVLQVSIGPGLPKNSRPTRRNTTQNTGYSSGTQNANYPVRAAPPPPGYHQNGVIRNQYVPYPHAPGSQRSNQKSLYTSMARPPLPRQQSTSSDRVSQTPESLDFLKVPDQGAAGVRRQTTSRPPPAGGRPKPQPKPKPQVPQCKALYAYDAQDTDELSFNANDIIDIIKEDPSGWWTGRLRGKQGLFPNNYVTKI

SEQ ID NO: 54600 - protein, 1103 aa, Homo sapiens
GTKAGSPVNGQKQGHAQATPKIPLNLHLHHDPFRSLQEPRHQPPTMGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDGGKISNFLLEKSRVVMQNENERNFHIYYQLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYAGKVSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKPIKRDLILTPKCVYVIGREKVKKGPEKGQVCEVLKKKVDIQALRGVSLSTRQDDFFILQEDAADSFLESVFKTEFVSLLCKRFEEATRRPLPLTFSDTLQFRVKKEGWGGGGTRSVTFSRGFGDLAVLKVGGRTLTVSVGDGLPKSSKPTRKGMAKGKPRRSSQAPTRAAPAPPRGMDRNGVPPSARGGPLPGDHVWRGHPQASPGLRPHPWEPADDPGHVRPQSTTQNSSTCLTRAWPACRGSAAWGNGQCLVWADPSPSLGHMVPGAGPYTSTWAKMWTS

SEQ ID NO: 54601 - protein, 1098 aa, Homo sapiens
MGSKERFHWQSHNVKQSGVDDMVLLPQITEDAIAANLRKRFMDDYIFTYIGSVLISVNPFKQMPYFTDREIDLYQGAAQYENPPHIYALTDNMYRNMLIDCENQCVIISGESGAGKTVAAKYIMGYISKVSGGGEKVQHVKDIILQSNPLLEAFGNAKTVRNNNSSRFGKYFEIQFSRGGEPDGGKISNFLLEKSRVVMQNENERNFHIYYQLLEGASQEQRQNLGLMTPDYYYYLNQSDTYQVDGTDDRSDFGETLSAMQVIGIPPSIQQLVLQLVAGILHLGNISFCEDGNYARVESVDLLAFPAYLLGIDSGRLQEKLTSRKMDSRWGGRSESINVTLNVEQAAYTRDALAKGLYARLFDFLVEAINRAMQKPQEEYSIGVLDIYGFEIFQKNGFEQFCINFVNEKLQQIFIELTLKAEQEEYVQEGIRWTPIQYFNNKVVCDLIENKLSPPGIMSVLDDVCATMHATGGGADQTLLQKLQAAVGTHEHFNSWSAGFVIHHYAGKVSYDVSGFCERNRDVLFSDLIELMQTSEQAFLRMLFPEKLDGDKKGRPSTAGSKIKKQANDLVATLMRCTPHYIRCIKPNETKRPRDWEENRVKHQVEYLGLKENIRVRRAGFAYRRQFAKFLQRYAILTPETWPRWRGDERQGVQHLLRAVNMEPDQYQMGSTKVFVKNPESLFLLEEVRERKFDGFARTIQKAWRRHVAVRKYEEMREEASNILLNKKERRRNSINRNFVGDYLGLEERPELRQFLGKRERVDFADSVTKYDRRFKPIKRDLILTPKCVYVIGREKVKKGPEKGQVCEVLKKKVDIQALRGVSLSTRQDDFFILQEDAADSFLESVFKTEFVSLLCKRFEEATRRPLPLTFSDTLQFRVKKEGWGGGGTRSVTFSRGFGDLAVLKVGGRTLTVSVGDGLPKSSKPTRKGMAKGKPRRSSQAPTRAAPAPPRGMDRNGVPPSARGGPLPLEIMSGGGTHRPPRGPPSTSLGASRRPRARPPSEHNTEFLNVPDQGMAGMQRKRSVGQRPVPGVGRPKPQPRTHGPRCRALYQYVGQDVDELSFNVNEVIEILMEDPSGWWKGRLHGQEGLFPGNYVEKI

SEQ ID NO: 54602 - protein, 1018 aa, Homo sapiens
MEDEEGPEYGKPDFVLLDQVTMEDFMRNLQLRFEKGRIYTYIGEVLVSVNPYQELPLYGPEAIARYQGRELYERPPHLYAVANAAYKAMKHRSRDTCIVISGESGAGKTEASKHIMQYIAAVTNPSQRAEVERVKDVLLKSTCVLEAFGNARTNRNHNSSRFGKYMDINFDFKGDPIGGHIHSYLLEKSRVLKQHVGERNFHAFYQLLRGSEDKQLHELHLERNPAVYNFTHQGAGLNMTVHSALDSDEQSHQAVTEAMRVIGFSPEEVESVHRILAAILHLGNIEFVETEEGGLQKEGLAVAEEALVDHVAELTATPRDLVLRSLLARTVASGGRELIEKGHTAAEASYARDACAKAVYQRLFEWVVNRINSVMEPRGRDPRRDGKDTVIGVLDIYGFEVFPVNSFEQFCINYCNEKLQQLFIQLILKQEQEEYEREGITWQSVEYFNNATIVDLVERPHRGILAVLDEACSSAGTITDRIFLQTLDMHHRHHLHYTSRQLCPTDKTMEFGRDFRIKHYAGDVTYSVEGFIDKNRDFLFQDFKRLLYNSTDPTLRAMWPDGQQDITEVTKRPLTAGTLFKNSMVALVENLASKEPFYVRCIKPNEDKVAGKLDENHCRHQVAYLGLLENVRVRRAGFASRQPYSRFLLRYKMTCEYTWPNHLLGSDKAAVSALLEQHGLQGDVAFGHSKLFIRSPRTLVTLEQSRARLIPIIVLLLQKAWRGTLARWRCRRLRAIYTIMRWFRRHKVRAHLAELQRRFQAARQPPLYGRDLVWPLPPAVLQPFQDTCHALFCRWRARQLVKNIPPSDMPQIKAKVAAMGALQGLRQDWGCRRAWARDYLSSATDNPTASSLFAQRLKTLQDKDGFGAVLFSSHVRKVNRFHKIRNRALLLTDQHLYKLDPDRQYRVMRAVPLEAVTGLSVTSGGDQLVVLHARGQDDLVVCLHRSRPPLDNRVGELVGVLAAHCQGEGRTLEVRVSDCIPLSHRGVRRLISVEPRPEQPEPDFRCARGSFTLLWPSR

SEQ ID NO: 54603 - protein, 1616 aa, Homo sapiens
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRNPPPKLRQPELWSAEFNDFISKCLTKDYEKRPTVSELLQHKFITQIEGKDVMLQKQLTEFIGIHQCMGGTEKARRERIHTKKGNFNRPLISNLKDVDDLATLEILDENTVSEQLEKCYSRDQIYVYVGDILIALNPFQSLGLYSTKHSKLYIGSKRTASPPHIFAMADLGYQSMITYNSDQCIVISGESGAGKTENAHLLVQQLTVLGKANNRTLQEKILQVNNLVEAFGNACTIINDNSSRFGKYLEMKFTSSGAVVGAQISEYLLEKSRVIHQAIGEKNFHIFYYIYAGLAEKKKLAHYKLPENKPPRYLQNDHLRTVQDIMNNSFYKSQYELIEQCFKVIGFTMEQLGSIYSILAAILNVGNIEFSSVATEHQIDKSHISNHTALENCASLLCIRADELQEALTSHCVVTRGETIIRPNTVEKATDVRDAMAKTLYGRLFSWIVNCINSLLKHDSSPSGNGDELSIGILDIFGFENFKKNSFEQLCINIANEQIQYYYNQHVFAWEQNEYLNEDVDARVIEYEDNWPLLDMFLQKPMGLLSLLDEESRFPKATDQTLVEKFEGNLKSQYFWRPKRMELSFGIHHYAGKVLYNASGFLAKNRDTLPTDIVLLLRSSDNSVIRQLVNHPLTKTGNLPHSKTKNVINYQMRTSEKLINLAKGDTGEATRHARETTNMKTQTVASYFRYSLMDLLSKMVVGQPHFVRCIKPNSERQARKYDKEKVLLQLRYTGILETARIRRLGFSHRILFANFIKRYYLLCYKSSEEPRMSPDTCATILEKAGLDNWALGKTKVFLKYYHVEQLNLMRKEAIDKLILIQACVRAFLCSRRYQKIQEKRKESAIIIQSAARGHLVRKQRKEIVDMKNTAVTTIQTSDQEFDYKKNFENTRESFVKKQAENAISANERFISAPNNKGSVSVVKTSTFKPEEETTNAVESNNRVYQTPKKMNNVYEEEVKQEFYLVGPEVSPKQKSVKDLEENSNLRKVEKEEAMIQSYYQRYTEERNCEESKAAYLERKAISERPSYPVPWLAENETSFKKTLEPTLSQRSIYQNANSMEKEKKTSVVTQRAPICSQEEGRGRLRHETVKERQVEPVTQAQEEEDKAAVFIQSKYRGYKRRQQLRKDKMSSFKHQRIVTTPTEVARNTHNLYSYPTKHEEINNIKKKDNKDSKATSEREACGLAIFSKQISKLSEEYFILQKKLNEMILSQQLKSLYLGVSHHKPINRRVSSQQCLSGVCKGEEPKILRPPRRPRKPKTLNNPEDSTYYYLLHKSIQEEKRRPRKDSQGKLLDLEDFYYKEFLPSRSGPKEHSPSLRERRPQQELQNQCIKANERCWAAESPEKEEEREPAANPYDFRRLLRKTSQRRRLVQQS

SEQ ID NO: 54604 - protein, 197 aa, Homo sapiens
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVR

SEQ ID NO: 54605 - protein, 247 aa, Homo sapiens
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRSDD

SEQ ID NO: 54606 - protein, 664 aa, Homo sapiens
MFPLIGKTIIFDNFPDPSDTWEITETIGKGTYGKVFKVLNKKNGQKAAVKILDPIHDIDEEIEAEYNILKALSDHPNVVRFYGIYFKKDKVNGDKLWLVLELCSGGSVTDLVKGFLKRGERMSEPLIAYILHEALMGLQHLHNNKTIHRDVKGNNILLTTEGGVKLVDFGVSAQLTSTRHRRNTSVGTPFWMAPEVIACEQQLDTTYDARCDTWSLGITAIELGDGDPPLADLHPMRALFKIPRNPPPKLRQPELWSAEFNDFISKCLTKDYEKRPTVSELLQHKFITQIEGKDVMLQKQLTEFIGIHQCMGGTEKARRERIHTKKGNFNRPLISNLKDVDDLATLEILDENTVSEQLEKCYSRDQIYVYVGDILIALNPFQSLGLYSTKHSKLYIGSKRTASPPHIFAMADLGYQSMITYNSDQCIVISGESGAGKTENAHLLVQQLTVLGKANNRTLQEKILQVNNLVEAFGNACTIINDNSSRFGKYLEMKFTSSGAVVGAQISEYLLEKSRVIHQAIGEKNFHIFYYIYAGLAEKKKLAHYKLPENKPPRYLQNDHLRTVQDIMNNSFYKSQYELIEQCFKVIGFTMEVLGGGEPREGGGERASSQPLRLQEAPAQNLPAPAPRPAVLTVQRGSHRRRKALEPAGQQGPSRHSGAGTSRH

SEQ ID NO: 54607 - protein, 1277 aa, Homo sapiens
KHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQSAWRGYDARRKFKKISNRRNESAAHNQAGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPAFPHYGCNFYGFRKWSCTEASNTSPTMSAAQNAE

SEQ ID NO: 54608 - protein, 1350 aa, Homo sapiens
MLQSALLSTRKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQSAWRGYDARRKFKKISNRRNESAAHNQAGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPGSENGLAQKHRTPRRRCQQPKMLSSPEDTMYYNQLNGTLEYQGSKRKPRKLGQIKVLDGEDEYYKSLSPVDCIPEENNSAHPSFFSSSSKGDSFAQH

SEQ ID NO: 54609 - protein, 1341 aa, Homo sapiens
MKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQSAWRGYDARRKFKKISNRRNESAAHNQAGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPGSENGLAQKHRTPRRRCQQPKMLSSPEDTMYYNQLNGTLEYQGSKRKPRKLGQIKVLDGEDEYYKSLSPVDCIPEENNSAHPSFFSSSSKGDSFAQH

SEQ ID NO: 54610 - protein, 1314 aa, Homo sapiens
MKHLYGLFHYNPMMLGLESLPDPTDTWEIIETIGKGTYGKVYKVTNKRDGSLAAVKILDPVSDMDEEIEAEYNILQFLPNHPNVVKFYGMFYKADHCVGGQLWLVLELCNGGSVTELVKGLLRCGQRLDEAMISYILYGALLGLQHLHNNRIIHRDVKGNNILLTTEGGVKLVDFGVSAQLTSTRLRRNTSVGTPFWMAPEVIACEQQYDSSYDARCDVWSLGITAIELGDGDPPLFDMHPVKTLFKIPRNPPPTLLHPEKWCEEFNHFISQCLIKDFERRPSVTHLLDHPFIKGVHGKVLFLQKQLAKVLQDQKHQNPVAKTRHERMHTRRPYHVEDAEKYCLEDDLVNLEVLDEDTIIHQLQKRYADLLIYTYVGDILIALNPFQNLSIYSPQFSRLYHGVKRASNPPHIFASADAAYQCMVTLSKDQCIVISGESGSGKTESAHLIVQHLTFLGKANNQTLREKILQVNSLVEAFGNSCTAINDNSSRFGKYLEMMFTPTGVVMGARISEYLLEKSRVIKQAAREKNFHIFYYIYAGLHHQKKLSDFRLPEEKPPRYIADETGRVMHDITSKESYRRQFEAIQHCFRIIGFTDKEVHSVYRILAGILNIGNIEFAAISSQHQTDKSEVPNAEALQNAASVLCISPEELQEALTSHCVVTRGETIIRANTVDRAADVRDAMSKALYGRLFSWIVNRINTLLQPDENICSAGGGMNVGILDIFGFENFQRNSFEQLCINIANEQIQYYFNQHVFALEQMEYQNEGIDAVPVEYEDNRPLLDMFLQKPLGLLALLDEESRFPQATDQTLVDKFEDNLRCKYFWRPKGVELCFGIQHYAGKVLYDASGVLEKNRDTLPADVVVVLRTSENKLLQQLFSIPLTKTGNLAQTRARITVASSSLPPHFSAGKAKVDTLEVIRHPEETTNMKRQTVASYFRYSLMDLLSKMVVGQPHFVRCIKPNDDREALQFSRERVLAQLRSTGILETVSIRRQGYSHRILFEEFVKRYYYLAFTAHQTPLASKESCVAILEKSRLDHWVLGKTKVFLKYYHVEQLNLLLREVIGRVVVLQAYTKGWLGARRYKRVREKREKGAIAIQSGDTSNQSSGPHSPVAAGTRGSAEVQDCSEPGDHKVLRGSVHRRSHSQAESNNGRTQTSSNSPAVTEKNGHSQAQSSPKGCDIFAGHANKHSVSGTDLLSSRICHPAPDQQGLSLWGAPQKPGSENGLAQKHRTPRRRCQQPKMLSSPEDTMYYNQLNGTLEYQGSKRKPRKLGQIKVLDGEDEYYKSLSPVDCIPEENNSAHPSFFSSSSKGDSFAQH

SEQ ID NO: 54611 - protein, 1129 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKNYPFAINM

SEQ ID NO: 54612 - protein, 2548 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 54613 - protein, 2619 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQREVARPAHKKKARMARTRSDFLTRGTFADGEGDTEEDDYDDIIEPLLSLDQASHCELGPAPSLGQASHSDSEMTSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 54614 - protein, 2529 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGHDDTAPCAILKSMDSFSFLQHPVHQRSLEILQRCKEEKYSITRKNPRTPLSDLQGMNALNEKNQHDTFDIAWNGRTGIRQSRLSSGTSLLDKDGIFANSTSSKLLERAHGILTRNKNFKSKPALPKHLLEVNSLKHLTRLTLQDRITKSLLHLHKKKKPPSISAQFQASLSKLMETLGQAEPYFVKCIRSNAEKLPLRFSDVLVLRQLRYTGMLETVRIRQSGYSSKYSFQDFVSHFHVLLPRNIIPSKFNIQDFFRKINLNPDNYQVGKTMVFLKEQERQHLQDLLHQEVLRRIILLQRWFRVLLCRQHFLHLRQASVIIQRFWRNYLNQKQVRDAAVQKDAFVMASAAALLQASWRAHLERQRYLELRAAAIVIQQKWRDYYRRRHMAAICIQARWKAYRESKRYQEQRKKIILLQSTCRGFRARQRFKALKEQRLRETKPEVGLVNIKGYGSLEIQGSDPSGWEDCSFDNRIKAIEECKSVIESNRISRESSVDCLKESPNKQQERAQSQSGVDLQEDVLVRERPRSLEDLHQKKVGRAKRESRRMRELEQAIFSLELLKVRSLGGISPSEDRRWSTELVPEGLQSPRGTPDSESSQGSLELLSYEESQKSKLESVISDEGDLQFPSPKISSSPKFDSRDNALSASNETSSAEHLKDGTMKEMVVCSSESITCKPQLKDSFISNSLPTFFYIPQQDPLKTNSQLDTSIQRNKLLENEDTAGEALTLDINRETRRYHCSGKDQIVPSLNTESSNPVLKKLEKLNTEKEERQKQLQQQNEKEMMEQIRQQTDILEKERKAFKTIEKPRIGECLVAPSSYQSKQRVERPSSLLSLNTSNKGELNVLGSLSLKDAALAQKDSSSAHLPPKDRPVTVFFERKGSPCQSSTVKELSKTDRMGTQLNVACKLSNNRISKREHFRPTQSYSHNSDDLSREGNARPIFFTPKDNMSIPLVSKEALNSKNPQLHKEDEPAWKPVKLAGPGQRETSQRFSSVDEQAKLHKTMSQGEITKLAVRQKASDSDIRPQRAKMRFWAKGKQGEKKTTRVKPTTQSEVSPLFAGTDVIPAHQFPDELAAYHPTPPLSPELPGSCRKEFKENKEPSPKAKRKRSVKISNVALDSMHWQNDSVQIIASVSDLKSMDEFLLKKVNDLDNEDSKKDTLVDVVFKKALKEFRQNIFSFYSSALAMDDGKSIRYKDLYALFEQILEKTMRLEQRDSLGESPVRVWVNTFKVFLDEYMNEFKTSDCTATKVPKTERKKRRKKETDLVEEHNGHIFKATQYSIPTYCEYCSSLIWIMDRASVCKLCKYACHKKCCLKTTAKCSKKYDPELSSRQFGVELSRLTSEDRTVPLVVEKLINYIEMHGLYTEGIYRKSGSTNKIKELRQGLDTDAESVNLDDYNIHVIASVFKQWLRDLPNPLMTFELYEEFLRAMGLQERKETIRGVYSVIDQLSRTHLNTLERLIFHLVRIALQEDTNRMSANALAIVFAPCILRCPDTTDPLQSVQDISKTTTCVELIVVEQMNKYKARLKDISSLEFAENKAKTRLSLIRRSMGKGRIRRGNYPGPSSPVVVRLPSVSDVSEETLTSEAAMETDITEQQQAAMQQEERVLTEQIENLQKEKEELTFEMLVLEPRASDDETLESEASIGTADSSENLNMESEYAISEKSERSLALSSLKTAGKSEPSSKLRKQLKKQQDSLDVVDSSVSSLCLSNTASSHGTRKLFQIYSKSPFYRAASGNEALGMEGPLGQTKFLEDKPQFISRGTFNPEKGKQKLKNVKNSPQKTKETPEGTVMSGRRKTVDPDCTSNQQLALFGNNEFMV

SEQ ID NO: 54615 - protein, 729 aa, Homo sapiens
MNINDGGRRRFEDNEHTLRIYPGAISEGTIYCPIPARKNSTAAEVIESLINKLHLDKTKCYVLAEVKEFGGEEWILNPTDCPVQRMMLWPRMALENRLSGEDYRFLLREKNLDGSIHYGSLQSWLRVTEERRRMMERGFLPQPQQKDFDDLCSLPDLNEKTLLENLRNRFKHEKIYTYVGSILIVINPFKFLPIYNPKYVKMYDNHQLGKLEPHIYAVADVAYHAMLQRKKNQCIVISGESGSGKTQSTNFLIHHLTALSQKGFASGVEQIILGAGPVLEAFGNAKTAHNNNSSRFGKFIQVNYQETGTVLGAYVEKYLLEKSRLVYQEHNERNYHVFYYLLAGASEDERSAFHLKQPEEYHYLNQITKKPLRQSWDDYCYDSEPDCFTVEGEDLRHDFERLQLAMEMVGFLPKTRRQIFSLLSAILHLGNICYKKKTYRDDSIDICNPEVLPIVSELLEVKEEMLFEALVTRKTVTVGEKLILPYKLAEAVTVRNSMAKSLYSALFDWIVFRINHALLNSKDLEHNTKTLSIGVLDIFGFEDYENNSFEQFCINFANERLQHYFNQHIFKLEQEEYRTEGISWHNIDYIDNTCCINLISKKPTGLLHLLDEESNFPQATNQTLLDKFKHQHEDNSYIEFPAVMEPAFIIKHYAGKVKYGVKDFREKNTDHMRPDIVALLRSSKNAFISGMIGIDPVAVFRWAILRAFFRAMVAFREAGKRNIHRKTGK

SEQ ID NO: 54616 - protein, 502 aa, Homo sapiens
MDKALLCSVCKMTCHKKCVHKIQSHCSYTYGRKGEPGVEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLLAVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKQDITYRLPELDPRGSDEENLDSETSASTESLLEERAGRGASEGPPAPALPCPGAPTPSPLPTVAAPPRRRPSSFVTVRVKTPRRTPIMPTANIKLPPGLPSHLPRWAPGAREAAAPVRRREPPARRPDQIHSVYITPGADLPVQGALEPLEEDGQPPGAKRRYSDPPTYCLPPASGQTNG

SEQ ID NO: 54617 - protein, 2022 aa, Homo sapiens
MSVKEAGSSGRREQAAYHLHIYPQLSTTESQASCRVTATKDSTTSDVIKDAIASLRLDGTKCYVLVEVKESGGEEWVLDANDSPVHRVLLWPRRAQDEHPQEDGYYFLLQERNADGTIKYVHMQLVAQATATRRLVERGLLPRQQADFDDLCNLPELTEGNLLKNLKHRFLQQKIYTYAGSILVAINPFKFLPIYNPKYVKMYENQQLGKLEPHVFALADVAYYTMLRKRVNQCIVISGESGSGKTQSTNFLIHCLTALSQKGYASGVERTILGAGPVLEAFGNAKTAHNNNSSRFGKFIQVSYLESGIVRGAVVEKYLLEKSRLVSQEKDERNYHVFYYLLLGVSEEERQEFQLKQPEDYFYLNQHNLKIEDGEDLKHDFERLKQAMEMVGFLPATKKQIFAVLSAILYLGNVTYKKRATGREEGLEVGPPEVLDTLSQLLKVKREILVEVLTKRKTVTVNDKLILPYSLSEAITARDSMAKSLYSALFDWIVLRINHALLNKKDVEEAVSCLSIGVLDIFGFEDFERNSFEQFCINYANEQLQYYFNQHIFKLEQEEYQGEGITWHNIGYTDNVGCIHLISKKPTGLFYLLDEESNFPHATSQTLLAKFKQQHEDNKYFLGTPVMEPAFIIQHFAGKVKYQIKDFREKNMDYMRPDIVALLRGSDSSYVRELIGMDPVAVFRWAVLRAAIRAMAVLREAGRLRAERAEKAAGMSSPGAQSHPEELPRGASTPSEKLYRDLHNQMIKSIKGLPWQGEDPRSLLQSLSRLQKPRAFILKSKGIKQKQIIPKNLLDSKSLKLIISMTLHDRTTKSLLHLHKKKKPPSISAQFQTSLNKLLEALGKAEPFFIRCIRSNAEKKELCFDDELVLQQLRYTGMLETVRIRRSGYSAKYTFQDFTEQFQVLLPKDAQPCREVISTLLEKMKIDKRNYQIGKTKVFLKETERQALQETLHREVVRKILLLQSWFRMVLERRHFLQMKRAAVTIQACWRSYRVRRALERTQAAVYLQASWRGYWQRKLYRHQKQSIIRLQSLCRGHLQRKSFSQMISEKQKAEEKEREALEAARAGAEEGGQGQAAGGQQVAEQGPEPAEDGGHLASEPEVQPSDRSPLEHSSPEKEAPSPEKTLPPQKTVAAESHEKVPSSREKRESRRQRGLEHVKFQNKHIQSCKEESALREPSRRVTQEQGVSLLEDKKESREDETLLVVETEAENTSQKQPTEQPQAMAVGKVSEETEKTLPSGSPRPGQLERPTSLALDSRVSPPAPGSAPETPEDKSKPCGSPRVQEKPDSPGGSTQIQRYLDAERLASAVELWRGKKLVAAASPSAMLSQSLDLSDRHRATGAALTPTEERRTSFSTSDVSKLLPSLAKAQPAAETTDGERSAKKPAVQKKKPGDASSLPDAGLSPGSQVDSKSTFKRLFLHKTKDKKYSLEGAEELENAVSGHVVLEATTMKKGLEAPSGQQHRHAAGEKRTKEPGGKGKKNRNVKIGKITVSEKWRESVFRQITNANELKYLDEFLLNKINDLRSQKTPIESLFIEATEKFRSNIKTMYSVPNGKIHVGYKDLMENYQIVVSNLATERGQKDTNLVLNLFQSLLDEFTRGYTKNDFEPVKQSKAQKKKRKQERAVQEHNGHVFASYQVSIPQSCEQCLSYIWLMDKALLCSVCKMTCHKKCVHKIQSHCSYTYGRKGEPGVEPGHFGVCVDSLTSDKASVPIVLEKLLEHVEMHGLYTEGLYRKSGAANRTRELRQALQTDPAAVKLENFPIHAITGVLKQWLRELPEPLMTFAQYGDFLRAVELPEKQEQLAAIYAVLEHLPEANHNSLERLIFHLVKVALLEDVNRMSPGALAIIFAPCLLRCPDNSDPLTSMKDVLKITTCVEMLIKEQMRKYKVKMEEISQLEAAESIAFRRLSLLRQNAPWPLKLGFSSPYEGVLNKSPKTRDIQEEELEVLLEEEAAGGDEDREKEILIERIQSIKEEKEDITYRLPELDPRGSDEENLDSETSASTESLLEERAGRGASEGQY

SEQ ID NO: 54618 - protein, 2022 aa, Homo sapiens; identical to SEQ ID NO: 54617

SEQ ID NO: 54619 - protein, 172 aa, Homo sapiens
MSSKKAKTKTTKKRPQRATSNVFAMFDQSQIQEFKEAFNMIDQNRDGFIDKEDLHDMLASLGKNPTDAYLDAMMNEAPGPINFTMFLTMFGEKLNGTDPEDVIRNAFACFDEEATGTIQEDYLRELLTTMGDRFTDEEVDELYREAPIDKKGNFNYIEFTRILKHGAKDKDD

SEQ ID NO: 54620 - protein, 596 aa, Homo sapiens
MATENGAVELGIQNPSTDKAPKGPTGERPLAAGKDPGPPDPKKAPDPPTLKKDAKAPASEKGDGTLAQPSTSSQGPKGEGDRGGGPAEGSAGPPAALPQQTATPETSVKKPKAEQGASGSQDPGKPRVGKKAAEGQAAARRGSPAFLHSPSCPAIISSSEKLLAKKPPSEASELTFEGVPMTHSPTDPRPAKAEEGKNILAESQKEVGEKTPGQAGQAKMQGDTSRGIEFQAVPSEKSEVGQALCLTAREEDCFQILDDCPPPPAPFPHRMVELRTGNVSSEFSMNSKEALGGGKFGAVCTCMEKATGLKLAAKVIKKQTPKDKEMVLLEIEVMNQLNHRNLIQLYAAIETPHEIVLFMEYIEGGELFERIVDEDYHLTEVDTMVFVRQICDGILFMHKMRVLHLDLKPENILCVNTTGHLVKIIDFGLARRYNPNEKLKVNFGTPEFLSPEVVNYDQISDKTDMWSMGVITYMLLSGLSPFLGDDDTETLNNVLSGNWYFDEETFEAVSDEAKDFVSNLIVKDQRARMNAAQCLAHPWLNNLAEKAKRCNRRLKSQILLKKYLMKRRWKKNFIAVSAANRFKKISSSGALMALGV

SEQ ID NO: 54621 - protein, 596 aa, Homo sapiens; identical to SEQ ID NO: 54620

SEQ ID NO: 54622 - protein, 819 aa, Homo sapiens
MSGTSKESLGHGGLPGLGKTCLTTMDTKLNMLNEKVDQLLHFQEDVTEKLQSMCRDMGHLERGLHRLEASRAPGPGGADGVPHIDTQAGWPEVLELVRAMQQDAAQHGARLEALFRMVAAVDRAIALVGATFQKSKVADFLMQGRVPWRRGSPGDSPEENKERVEEEGGKPKHVLSTSGVQSDAREPGEESQKADVLEGTAERLPPIRASGLGADPAQAVVSPGQGDGVPGPAQAFPGHLPLPTKVEAKAPETPSENLRTGLELAPAPGRVNVVSPSLEVAPGAGQGASSSRPDPEPLEEGTRLTPGPGPQCPGPPGLPAQARATHSGGETPPRISIHIQEMDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 54623 - protein, 478 aa, Homo sapiens
MDTPGEMLMTGRGSLGPTLTTEAPAAAQPGKQGPPGTGRCLQAPGTEPGEQTPEGARELSPLQESSSPGGVKAEEEQRAGAEPGTRPSLARSDDNDHEVGALGLQQGKSPGAGNPEPEQDCAARAPVRAEAVRRMPPGAEAGSVVLDDSPAPPAPFEHRVVSVKETSISAGYEVCQHEVLGGGRFGQVHRCTEKSTGLPLAAKIIKVKSAKDREDVKNEINIMNQLSHVNLIQLYDAFESKHSCTLVMEYVDGGELFDRITDEKYHLTELDVVLFTRQICEGVHYLHQHYILHLDLKPENILCVNQTGHQIKIIDFGLARRYKPREKLKVNFGTPEFLAPEVVNYEFVSFPTDMWSVGVITYMLLSGLSPFLGETDAETMNFIVNCSWDFDADTFEGLSEEAKDFVSRLLVKEKSCRMSATQCLKHEWLNNLPAKASRSKTRLKSQLLLQKYIAQRKWKKHFYVVTAANRLRKFPTSP

SEQ ID NO: 54624 - protein, 1403 aa, Homo sapiens
  MOD_RES (1)..(1): Any amino acid
XLLLESCEKEKQALLQNLKEVEDKASAYEDQLQGQAQQVETLQKEKLSATFEGSEQVHQLEEQLEAREASVRRLAEHVQSLCDERDLLRQRFQELTERVATSDEDVAELREKLRRREADNQSLEHSYQRVSSQLQSMHTLLREKEEELERIKEAHEKVLEKKEQDLNEALVKMVALGSSLEETEIKLQAKEEILRKFASESPKDMEEPRSTPEETERDGTLLPGQPVQATRAPLGLPHTRLEDEDEDLGAPPGEEYGDGSPSREDSMVPPKSVEVLDREGHQQGTAKLDQGAPGVKRQRIRFSTIQCQRYIHPEGSEKTWTSSTSSDTSQDRSPSEESMSSEPAPSVLPATGDSDTYLSIIHSLETKLYVTEEKLKDVTVRLESQQGQSREALLALHHQWAGTEAQLREQLRASLLQVGALASQLEQERQERARRVEGHVGELGDFQVKNSQALMCLENCREQLRSLPRASQEDEQDARAASLASVESALVSAIQALQHWPAPAHGGARAQLETGGTEENGKPASLQQCSQSELTEQEQVRLLSDQIALEASLISQIADSLKNTTSDVSRMLHEISWSGQPPMESAGAPVDTWARKVLVDGEFWSQVESLRKHLGTLGGEAVGASGDGQQSIPQGLAPILANATWVRAELSFATQSVRESFHRRLQSIQETLRGTQTALRQHKCLLREILGAYQTPDFERVMQQVLEALRLPAGHEDGVQLSWDLSPLGEVLGRDSDSSQEPFDVSDQSPGAFVAIQEELAQQLKEKASLLEEIAAALPSLPPVESLRDCQKLLQVSQSLSYNTCLGGLGQYSSLLVQDAIIQAQVCYASCRIRLEYEKELQLCKESWQTREPSCSEQAQAARALREEYEELLRKQKSEYLDVIAIVERENAELKAKAAQLDHQQQCLEDAESKHSMSMFTLRGRYEEEIRCVVEQLTRTESTLQAERSRVLSQLDASVRDRQDMERHHGEQIQTLEDRFQLKVRELQTIHEEELRTLQEHYSQSLRCLQDTLCLHQGPHPKALPAPAPNWQATQGEADSMTGLRERIQELEAQMDVMREELGHKDLEGDAATLREKYQRDLESLKATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54625 - protein, 1025 aa, Homo sapiens
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 54626 - protein, 1025 aa, Homo sapiens; identical to SEQ ID NO: 54625

SEQ ID NO: 54627 - protein, 63 aa, Homo sapiens
MSAAKENPCRKFQANIFNKSKCQNCFKPRESHLLNDEDLTQQNTHPLEMKRGAHIYDARMFSC

SEQ ID NO: 54628 - protein, 93 aa, Homo sapiens [sequence omitted]

SEQ ID NO: 54629 - protein, 1038 aa, Homo sapiens
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRDFTNEAPPAPLPDASASPLSPHRRAKSLDRRSTEPSVTPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54630 - protein, 1091 aa, Homo sapiens
  MOD_RES (1)..(1): Any amino acid
XRFSTIQCQRYIHPEGSEKTWTSSTSSDTSQDRSPSEESMSSEPAPSVLPATGDSDTYLSIIHSLETKLYVTEEKLKDVTVRLESQQGQSREALLALHHQWAGTEAQLREQLRASLLQVGALASQLEQERQERARRVEGHVGELGDFQVKNSQALMCLENCREQLRSLPRASQEDEQDARAASLASVESALVSAIQALQHWPAPAHGGARAQLETGGTEENGKPASLQQCSQSELTEQEQVRLLSDQIALEASLISQIADSLKNTTSDVSRMLHEISWSGQPPMESAGAPVDTWARKVLVDGEFWSQVESLRKHLGTLGGEAVGASGDGQQSIPQGLAPILANATWVRAELSFATQSVRESFHRRLQSIQETLRGTQTALRQHKCLLREILGAYQTPDFERVMQQVLEALRLPAGHEDGVQLSWDLSPLGEVLGRDSDSSQEPFDVSDQSPGAFVAIQEELAQQLKEKASLLEEIAAALPSLPPVESLRDCQKLLQVSQSLSYNTCLGGLGQYSSLLVQDAIIQAQVCYASCRIRLEYEKELQLCKESWQTREPSCSEQAQAARALREEYEELLRKQKSEYLDVIAIVERENAELKAKAAQLDHQQQCLEDAESKHSMSMFTLRGRYEEEIRCVVEQLTRTESTLQAERSRVLSQLDASVRDRQDMERHHGEQIQTLEDRFQLKVRELQTIHEEELRTLQEHYSQSLRCLQDTLCLHQGPHPKALPAPAPNWQATQGEADSMTGLRERIQELEAQMDVMREELGHKDLEGDAATLREKYQRDLESLKATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSVIEQVSWDT

SEQ ID NO: 54631 - protein, 279 aa, Homo sapiens
  MOD_RES (1)..(1): Any amino acid
XQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQTEVAASPSGAWQRLHRVNQDLQSELEAQCQRQELITHQIQTLKRSYGEAKDTIRHHEAEIRSLQARLSNAA

SEQ ID NO: 54632 - protein, 194 aa, Homo sapiens
LRQQTVEELQSVQRELEVLSEQYSQKCLENAHLAQALEAERQALRQCQRENQELNAHNQVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54633 - protein, 1000 aa, Homo sapiens
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRMDCGRKVRVESGYFSLEKTKQDLKAEEQQLPPPLSPPSPSTPNHRRSQVIEKFEALDIEKAEHMETNAVGPSPSSDTRQGRSEKRAFPRKRPDLLNFKKGWLTKQYEDGQWKKHWFVLADQSLRYYRDSVAEEAADLDGEIDLSACYDVTEYPVQRNYGFQIHTKEGEFTLSAMTSGIRRNWIQTIMKHVHPTTAPDVTSSLPEEKNKSSCSFETCPRPTEKQEAELGEPDPEQKRSRARERRREGRSKTFDWAEFRPIQQALAQERVGGVGPADTHEPLRPEAEPGELERERARRREERRKRFGMLDATDGPGTEDAALRMEVDRSPGLPMSDLKTHNVHVEIEQRWHQVETTPLREEKQVPIAPVHLSSEDGGDRLSTHELTSLLEKELEQSQKEASDLLEQNRLLQDQLRVALGREQSAREGYVLQATCERGFAAMEETHQKKIEDLQRQHQRELEKLREEKDRLLAEETAATISAIEAMKNAHREEMERELEKSQRSQISSVNSDVEALRRQYLEELQSVQRELEVLSEQYSQKCLENAHLAQALEAERQALRQCQRENQELNAHNQELNNRLAAEITRLRTLLTGDGGGEATGSPLAQGKDAYELEVLLRVKESEIQYLKQEISSLKDELQTALRDKKYASDKYKDIYTELSIAKAKADCDISRLKEQLKAATEALGEKSPDSATVSGYDIMKSKSNPDFLKKDRSCVTRQLRNIRSKSLKEGLTVQERLKLFESRDLKKD

SEQ ID NO: 54634 - protein, 264 aa, Homo sapiens
MENYGIEWHSVRDSEGQKLLIGVGPEGISICKDDFSPINRIAYPVVQMATQSGKNVYLTVTKESGNSIVLLFKMISTRAASGLYRAITETHAFYRCDTVTSAVMMQYSRDLKGHLASLFLNENINLGKKYVFDIKRTSKEVYDHARRALYNAGVVDLVSRNNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 54635 - protein, 445 aa, Homo sapiens
MLCYVTRPDAVLMEVEVEAKANGEDCLNQVCRRLGIIEVDYFGLQFTGSKGESLWLNLRNRISQQMDGLAPYRLKLRVKFFVEPHLILQEQTRHIFFLHIKEALLAGHLLCSPEQAVELSALLAQTKFGDYNQNTAKYNYEELCAKELSSATLNSIVAKHKELEGTSQASAEYQVLQIVSAMENYGIEWHSVRDSEGQKLLIGVGPEGISICKDDFSPINRIAYPVVQMATQSGKNVYLTVTKESGNSIVLLFKMISTRAASGLYRAITETHAFYRCDTVTSAVMMQYSRDLKGHLASLFLNENINLGKKYVFDIKRTSKEVYDHARRALYNAGVVDLVSRNNQSPSHSPLKSSESSMNCSSCEGLSCQQTRVLQEKLRKLKEAMLCMVCCEEEINSTFCPCGHTVCCESCAAQLQSCPVCRSRVEHVQHVYLPTHTSLLNLTVI

SEQ ID NO: 54636 - protein, 1828 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54637 - protein, 1880 aa, Homo sapiens
MKSSSLETMFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKLHENTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLYFEELYADDPKKYQSYRISLYKRMIDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54638 - protein, 1362 aa, Homo sapiens
MHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54639 - protein, 1855 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54640 - protein, 1852 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKNTMTDSTILLEDVQKMKDKGEIAQAYIGLKETNRSSALDYHELNEDGELWLVYEGLKQANRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54641 - protein, 1458 aa, Homo sapiens
MCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKLHENTMTDSTILLEDVQKMKDKGEIAQAYIGLKETNRLLESQLQSQKRSHENEAEALRGEIQSLKEENNRQQQLLAQNLQLPPEARIEASLQHEITRLTNENLDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54642 - protein, 1853 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEEERNYHIFYQLCASAKLPEFKMLRLGNADNFNYTKQGGSPVIEGVDDAKEMAHTRQACTLLGISESHQMGIFRILAGILHLGNVGFTSRDADSCTIPPKHEPLCIFCELMGVDYEEMCHWLCHRKLATATETYIKPISKLQATNARDALAKHIYAKLFNWIVDNVNQALHSAVKQHSFIGVLDIYGFETFEINSFEQFCINYANEKLQQQFNMHVFKLEQEEYMKEQIPWTLIDFYDNQPCINLIESKLGILDLLDEECKMPKGTDDTWAQKLYNTHLNKCALFEKPRLSNKAFIIQHFADKVEYQCEGFLEKNKDTVFEEQIKVLKSSKFKMLPELFQDDEKAISPTSATSSGRTPLTRTPAKPTKGRPGQMAKEHKKTVGHQFRNSLHLLMETLNATTPHYVRCIKPNDFKFPFTFDEKRAVQQLRACGVLETIRISAAGFPSRWTYQEFFSRYRVLMKQKDVLSDRKQTCKNVLEKLILDKDKYQFGKTKIFFRAGQVAYLEKLRADKLRAACIRIQKTIRGWLLRKKYLRMRKAAITMQRYVRGYQARCYAKFLRRTKAATIIQKYWRMYVVRRRYKIRRAATIVLQSYLRGFLARNRYRKILREHKAVIIQKRVRGWLARTHYKRSMHAIIYLQCCFRRMMAKRELKKLKIEARSVERYKKLHIGMENKIMQLQRKVDEQNKDYKCLVEKLTNLEGIYNSETEKLRSDLERLQLSEEEAKVATGRVLSLQEEIAKLRKDLEQTRSEKKCIEEHADRYKQETEQLVSNLKEENTLLKQEKEALNHRIVQQAKEMTETMEKKLVEETKQLELDLNDERLRYQNLLNEFSRLEERYDDLKEEMTLMVHVPKPGHKRTDSTHSSNESEYIFSSEIAEMEDIPSRTEEPSEKKVPLDMSLFLKLQKRVTELEQEKQVMQDELDRKEEQVLRSKAKEEERPQIRGAELEYESLKRQELESENKKLKNELNELRKALSEKSAPEVTAPGAPAYRVLMEQLTSVSEELDVRKEEVLILRSQLVSQKEAIQPKDDKNTMTDSTILLEDVQKMKDKGEIAQAYIGLKETNRLLESQLQSQKRSHENEAEALRGEIQSLKEENNRQQQLLAQNLQLPPEARIEASLQHEITRLTNENLYFEELYADDPKKYQSYRISLYKRMIDLMEQLEKQDKTVRKLKKQLKVFAKKIGELEVGQMENISPGQIIDEPIRPVNIPRKEKDFQGMLEYKKEDEQKLVKNLILELKPRGVAVNLIPGLPAYILFMCVRHADYLNDDQKVRSLLTSTINSIKKVLKKRGDDFETVSFWLSNTCRFLHCLKQYSGEEGFMKHNTSRQNEHCLTNFDLAEYRQVLSDLAIQIYQQLVRVLENILQPMIVSGMLEHETIQGVSGVKPTGLRKRTSSIADEGTYTLDSILRQLNSFHSVMCQHGMDPELIKQVVKQMFYIIGAITLNNLLLRKDMCSWSKGMQIRYNVSQLEEWLRDKNLMNSGAKETLEPLIQAAQLLQVKKKTDDDAEAICSMCNALTTAQIVKVLNLYTPVNEFEERVSVSFIRTIQMRLRDRKDSPQLLMDAKHIFPVTFPFNPSSLALETIQIPASLGLGFISRV

SEQ ID NO: 54643 - protein, 1848 aa, Homo sapiens
MSVGELYSQCTRVWIPDPDEVWRSAELTKDYKEGDKSLQLRLEDETILEYPIDVQRNQLPFLRNPDILVGENDLTALSYLHEPAVLHNLKVRFLESNHIYTYCGIVLVAINPYEQLPIYGQDVIYTYSGQNMGDMDPHIFAVAEEAYKQMARDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKALHTSLKQHSFIGVLDIYGFETFEVNSFEQFCINYANEKLQQQFNSHVFKLEQEEYMKEQIPWTLIDFYDNQPCIDLIEAKLGILDLLDEECKVPKGTDQNWAQKLYDRHSSSQHFQKPRMSNTAFIIVHFADKVEYLSDGFLEKNRDTVYEEQINILKASKFPLVADLFHDDKDPVPATTPGKGSSSKISVRSARPPMKVSNKEHKKTVGHQFRTSLHLLMETLNATTPHYVRCIKPNDEKLPFHFDPKRAVQQLRACGVLETIRISAAGYPSRWAYHDFFNRYRVLVKKRELANTDKKAICRSVLENLIKDPDKFQFGRTKIFFRAGQVAYLEKLRADKFRTATIMIQKTVRGWLQKVKYHRLKGATLTLQRYCRGHLARRLAEHLRRIRAAVVLQKHYRMQRARQAYQRVRRAAVVIQAFTRAMFVRRTYRQVLMEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNSKTEDWGYLNEDGELGLAYQGLKQVARLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 54644 - protein, 963 aa, Homo sapiens
MEHKATTIQKHVRGWMARRHFQRLRDAAIVIQCAFRMLKARRELKALRIEARSAEHLKRLNVGMENKVVQLQRKIDEQNKEFKTLSEQLSVTTSTYTMEVERLKKELVHYQQSPGEDTSLRLQEEVESLRTELQRAHSERKILEDAHSREKDELRKRVADLEQENALLKDEKEQLNNQILCQSKDEFAQNSVKENLMKKELEEERSRYQNLVKEYSQLEQRYDNLRDEMTIIKQTPGHRRNPSNQSSLESDSNYPSISTSEIGDTEDALQQVEEIGLEKAAMDMTVFLKLQKRVRELEQERKKLQVQLEKREQQDSKKVQAEPPQTDIDLDPNADLAYNSLKRQELESENKKLKNDLNELRKAVADQATQNNSSHGSPDSYSLLLNQLKLAHEELEVRKEEVLILRTQIVSADQRRLAGRNAEPNINARSSWPNSEKHVDQEDAIEAYHGVCQTNRLLEAQLQAQSLEHEEEVEHLKAQLEALKEEMDKQQQTFCQTLLLSPEAQVEFGVQQEISRLTNENLDLKELVEKLEKNERKLKKQLKIYMKKAQDLEAAQALAQSERKRHELNRQVTVQRKEKDFQGMLEYHKEDEALLIRNLVTDLKPQMLSGTVPCLPAYILYMCIRHADYTNDDLKVHSLLTSTINGIKKVLKKHNDDFEMTSFWLSNTCRLLHCLKQYSGDEGFMTQNTAKQNEHCLKNFDLTEYRQVLSDLSIQIYQQLIKIAEGVLQPMIVSAMLENESIQGLSGVKPTGYRKRSSSMADGDNSYCLEAIIRQMNAFHTVMCDQGLDPEIILQVFKQLFYMINAVTLNNLLLRKDVCSWSTGMQLRYNISQLEEWLRGRNLHQSGAVQTMEPLIQAAQLLQLKKKTQEDAEAICSLCTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 54645 - protein, 720 aa, Homo sapiens
MHWPVTRECTRVWIPDPDEVWRSAELTKDYKEGDKSLQLRLEDETILEYPIDVQRNQLPFLRNPDILVGENDLTALSYLHEPAVLHNLKVRFLESNHIYTYCGIVLVAINPYEQLPIYGQDVIYTYSGQNMGDMDPHIFAVAEEAYKQMARDEKNQSIIVSGESGAGKTVSAKYAMRYFATVGGSASETNIEEKVLASSPIMEAIGNAKTTRNDNSSRFGKYIQIGFDKRYHIIGANMRTYLLEKSRVVFQADDERNYHIFYQLCAAAGLPEFKELALTSAEDFFYTSQGGDTSIEGVDDAEDFEKTRQAFTLLGVKESHQMSIFKIIASILHLGSVAIQAERDGDSCSISPQDVYLSNFCRLLGVEHSQMEHWLCHRKLVTTSETYVKTMSLQQVINARNALAKHIYAQLFGWIVEHINKALHTSLKQHSFIGVLDIYGFETFEVNSFEQFCINYANEKLQQQFNSHVFKLEQEEYMKEQIPWTLIDFYDNQPCIDLIEAKLGILDLLDEECKVPKGTDQNWAQKLYDRHSSSQHFQKPRMSNTAFIIVHFADKVEYLSDGFLEKNRDTVYEEQINILKASKFPLVADLFHDDKDPVPATTPGKGSSSKISVRSARPPMKVSNKEHKKTVGHQFRTSLSTQQIVKILNLYTPLNEFEERVTVAFIRTIQAQLQERNDPQQLLLDAKHMFPVLFPFNPSSLTMDSIHIPACLNLEFLNEV

SEQ ID NO: 54646 - protein, 1742 aa, Homo sapiens
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSGKQHTFIGVLDIYGFETFDVNSFEQFCINYANEKLQQQFNMHVFKLEQEEYMKEDIPWTLIDFYDNQPVIDLIEAKMGILELLDEECLLPHGTDENWLQKLYNNFVNRNPLFEKPRMSNTSFVIQHFADKVEYKCEGFLEKNRDTVYDMLVEILRASKFHLCANFFQENPTPPSPFGSMITVKSAKQVIKPNSKHFRTTVGSKFRSSLYLLMETLNATTPHYVRCIKPNDEKLPFEFDSKRIVQQLRACGVLETIRISAQSYPSRWTYIEFYSRYGILMTKQELSFSDKKEVCKVVLHRLIQDSNQYQFGKTKIFFRAGQVAYLEKLRLDKLRQSCVMVQKHMRGWLQRKKFLRERRAALIIQQYFRGQQTVRKAITAVALKEAWAAIIIQKHCRGYLVRSLYQLIRMATITMQAYSRGFLARRRYRKMLEEHKAVILQKYARAWLARRRFQSIRRFVLNIQLTYRVQRLQKKLEDQNKENHGLVEKLTSLAALRAGDVEKIQKLEAELEKAATHRRNYEEKGKRYRDAVEEKLAKLQKHNSELETQKEQIQLKLQEKTEELKEKMDNLTKQLFDDVQKEERQRMLLEKSFELKTQDYEKQIQSLKEEIKALKDEKMQLQHLVEGEHVTSDGLKAEVARLSKQVKTISEFEKEIELLQAQKIDVEKHVQSQKREMREKMSEITKQLLESYDIEDVRSRLSVEDLEHLNEDGELWFAYEGLKKATRVLESHFQSQKDCYEKEIEALNFKVVHLSQEINHLQKLFREENDINESIRHEVTRLTSENMMIPDFKQQISELEKQKQDLEIRLNEQAEKMKGKLEELSNQLHRSQEEEGTQRKALEAQNEIHTKEKEKLIDKIQEMQEASDHLKKQFETESEVKCNFRQEASRLTLENRDLEEELDMKDRVIKKLQDQVKTLSKTIGKANDVHSSSGPKEYLGMLQYKREDEAKLIQNLILDLKPRGVVVNMIPGLPAHILFMCVRYADSLNDANMLKSLMNSTINGIKQVVKEHLEDFEMLSFWLSNTCHFLNCLKQYSGEEEFMKHNSPQQNKNCLNNFDLSEYRQILSDVAIRIYHQFIIIMEKNIQPIIVPGMLEYESLQGISGLKPTGFRKRSSSIDDTDGYTMTSVLQQLSYFYTTMCQNGLDPELVRQAVKQLFFLIGAVTLNSLFLRKDMCSCRKGMQIRCNISYLEEWLKDKNLQNSLAKETLEPLSQAAWLLQVKKTTDSDAKEIYERCTSLSAVQIIKILNSYTPIDDFEKRVTPSFVRKVQALLNSREDSSQLMLDTKYLFQVTFPFTPSPHALEMIQIPSSFKLGFLNRL

SEQ ID NO: 54647 - protein, 373 aa, Homo sapiens
MPSSTPTAGRTWAIWTHTYLPWQKRHTSRWPDGKSEAQDLDLLTLYLNLYCITPAAAPELPPLYVFVCELDSQRAPIPGSDAYNEGAGGAYMRNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSVLKPLM

SEQ ID NO: 54648 - protein, 106 aa, Homo sapiens
MNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRND

SEQ ID NO: 54649 - protein, 430 aa, Homo sapiens
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQSENERNYHIFYQLCASAQQSEFKHLKLGSAEEFNYTRMGGNTVIEGVNDRAEMVETQKTFTLLGFKEDFQMDVFKILAAILHLGNVQITAVGNERSSVSEDDSHLKVFCELLGLESGRVAQWLCNRKIVTSSETVVKPMTRPQAVNARDALAKKIYAHLFDFIVERINQALQFSVLKPLM

SEQ ID NO: 54650 - protein, 269 aa, Homo sapiens
MAVAELYTQYNRVWIPDPEEVWKSAEIAKDYRVGDKVLRLLLEDGTELDYSVNPESLPPLRNPDILVGENDLTALSYLHEPAVLHNLRIRFAESKLIYTYSGIILVAMNPYKQLPIYGDAIIHAYSGQNMGDMDPHIFAVAEEAYKQMARNNRNQSIIVSGESGAGKTVSARYAMRYFATVSKSGSNAHVEDKVLASNPITEAVGNAKTTRNDNSSRFGKYTEISFDEQNQIIGANMSTYLLEKSRVVFQGVPKNLIIQEWEAILSLRV

SEQ ID NO: 54651 - protein, 1253 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54652 - protein, 1285 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54653 - protein, 1286 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRYLDSYPVTSKNDGTRPKMTPEQMAKEMSEFLSRGPAVLATKAAAGTKKYDLSKWKYAELRDTINTSCDIELLAACREEFHRRLKVYHAWKSKNKKRNTETEQRAPKSVTDYAQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54654 - protein, 1262 aa, Homo sapiens
MEDGKPVWAPHPTDGFQMGNIVDIGPDSLTIEPLNQKGKTFLALINQVFPAEEDSKKDVEDNCSLMYLNEATLLHNIKVRYSKDRIYTYVANILIAVNPYFDIPKIYSSEAIKSYQGKSLGTRPPHVFAIADKAFRDMKVLKMSQSIIVSGESGAGKTENTKFVLRYLTESYGTGQDIDDRIVEANPLLEAFGNAKTVRNNNSSRFGKFVEIHFNEKSSVVGGFVSHYLLEKSRICVQGKEERNYHIFYRLCAGASEDIREKLHLSSPDNFRYLNRGCTRYFANKETDKQILQNRKSPEYLKAGSMKDPLLDDHGDFIRMCTAMKKIGLDDEEKLDLFRVVAGVLHLGNIDFEEAGSTSGGCNLKNKSAQSLEYCAELLGLDQDDLRVSLTTRVMLTTAGGTKGTVIKVPLKVEQANNARDALAKTVYSHLFDHVVNRVNQCFPFETSSYFIGVLDIAGFEYFEHNSFEQFCINYCNEKLQQFFNERILKEEQELYQKEGLGVNEVHYVDNQDCIDLIEAKLVGILDILDEENRLPQPSDQHFTSAVHQKHKDHFRLTIPRKSKLAVHRNIRDDEGFIIRHFAGAVCYETTQFVEKNNDALHMSLESLICESRDKFIRELFESSTNNNKDTKQKAGKLSFISVGNKFKTQLNLLLDKLRSTGASFIRCIKPNLKMTSHHFEGAQILSQLQCSGMVSVLDLMQGGYPSRASFHELYNMYKKYMPDKLARLDPRLFCKALFKALGLNENDYKFGLTKVFFRPGKFAEFDQIMKSDPDHLAELVKRVNHWLTCSRWKKVQWCSLSVIKLKNKIKYRAEACIKMQKTIRMWLCKRRHKPRIDGLVKVGTLKKRLDKFNEVVSVLKDGKPEMNKQIKNLEISIDTLMAKIKSTMMTQEQIQKEYDALVKSSEELLSALQKKKQQEEEAERLRRIQEEMEKERKRREEDEKRRRKEEEERRMKLEMEAKRKQEEEERKKREDDEKRIQAEVEAQLARQKEEESQQQAVLEQERRDRELALRIAQSEAELISDEAQADLALRRGPAVLATKAAAGTKKYDLSKWKYAELRDTINTSCDIELLAACREEFHRRLKVYHAWKSKNKKRNTETEQRAPKSVTDYDFAPFLNNSPQQNPAAQIPARQREIEMNRQQRFFRIPFIRPADQYKDPQSKKKGWWYAHFDGPWIARQMELHPDKPPILLVAGKDDMEMCELNLEETGLTRKRGAEILPRQFEEIWERCGGIQYLQNAIESRQARPTYATAMLQSLLK

SEQ ID NO: 54655 - protein, 1295 aa, Homo sapiens [sequence omitted]

SEQ ID NO: 54656 - protein, 174 aa, Homo sapiens
KRREEDEKRRRKEEEERRMKLEMEAKRKQEEEERKKREDDEKRIQAEVEAQLARQKEEESQQQAVLEQERRDRELALRIAQSEAELISDEAQADLALRSLDSYPVTSKNDGTRPKMTPGPAVLATKAAAGTKKYDLSKWKYAELRDTINTSCDIELLAACREEFHRRLKVYHAW

SEQ ID NO: 54657 - protein, 2091 aa, Homo sapiens
ALLQKGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54658 - protein, 2184 aa, Homo sapiens
ALLQKGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54659 - protein, 1202 aa, Homo sapiens
ALLQKGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEVLQAQLPEGQKKSSVRHKLVHLTLKKKSKLTEEVTKRLHDGESTVQGNSMLEDRPTSNLEKLHFIIGNGILRPALRSVPPESLLVAEWCLCQPSKRLSQAPGFGFAAS

SEQ ID NO: 54660 - protein, 2214 aa, Homo sapiens
ALLQKGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54661 - protein, 2215 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRECRVWLSLGCSDLGCAAPHSGWAGLTPAGPCSPCWSCRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54662 - protein, 1178 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRSVPGGGDTRA

SEQ ID NO: 54663 - protein, 2175 aa, Homo sapiens
MVILQQGDHVWMDLRLGQEFDVPIGAVVKLCDSGQVQVVDDEDNEHWISPQNATHIKPMHPTSVHGVEDMIRLGDLNEAGILRNLLIRYRDHLIYTYTGSILVAVNPYQLLSIYSPEHIRQYTNKKIGEMPPHIFAIADNCYFNMKRNSRDQCCIISGESGAGKTESTKLILQFLAAISGQHSWIEQQVLEATPILEAFGNAKTIRNDNSSRFGKYIDIHFNKRGAIEGAKIEQYLLEKSRVCRQALDERNYHVFYCMLEGMSEDQKKKLGLGQASDYNYLAMGNCITCEGRVDSQEYANIRSAMKVLMFTDTENWEISKLLAAILHLGNLQYEARTFENLDACEVLFSPSLATAASLLEVNPPDLMSCLTSRTLITRGETVSTPLSREQALDVRDAFVKGIYGRLFVWIVDKINAAIYKPPSQDVKNSRRSIGLLDIFGFENFAVNSFEQLCINFANEHLQQFFVRHVFKLEQEEYDLESIDWLHIEFTDNQDALDMIANKPMNIISLIDEESKFPKGTDTTMLHKLNSQHKLNANYIPPKNNHETQFGINHFAGIVYYETQGFLEKNRDTLHGDIIQLVHSSRNKFIKQIFQADVAMGAETRKRSPTLSSQFKRSLELLMRTLGACQPFFVRCIKPNEFKKPMLFDRHLCVRQLRYSGMMETIRIRRAGYPIRYSFVEFVERYRVLLPGVKPAYKQGDLRGTCQRMAEAVLGTHDDWQIGKTKIFLKDHHDMLLEVERDKAITDRVILLQKVIRGFKDRSNFLKLKNAATLIQRHWRGHNCRKNYGLMRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54664 - protein, 843 aa, Homo sapiens
GLSVQWLLDGLACFFASLHVPLGRVQLHASARGIQEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKVHHGLLRAEEEGNRALIKHRDSSLGLWERAMALDTCPGEGRRAAPSALSQLSVLAGVSPGDRGTRRSSAWQWRQTCKQAGVMEDGLCSDTGEPSPRWQSSGGSAGCEKAS

SEQ ID NO: 54665 - protein, 1388 aa, Homo sapiens
MRLGFLRLQALHRSRKLHQQYRLARQRIIQFQARCRAYLVRKAFRHRLWAVLTVQAYARGMIARRLHQRLRAEYLWRLEAEKMRLAEEEKLRKEMSAKKAKEEAERKHQERLAQLAREDAERELKEKEAARRKKELLEQMERARHEPVNHSDMVDKMFGFLGTSGGLPGQEGQAPSGFEDLERGRREMVEEDLDAALPLPDEDEEDLSEYKFAKFAATYFQGTTTHSYTRRPLKQPLLYHDDEGDQLAALAVWITILRFMGDLPEPKYHTAMSDGSEKIPVMTKIYETLGKKTYKRELQALQGEGEAQLPEGQKKSSVRHKLVHLTLKKKSKLTEEVTKRLHDGESTVQGNSMLEDRPTSNLEKLHFIIGNGILRPALRDEIYCQISKQLTHNPSKSSYARGWILVSLCVGCFAPSEKFVKYLRNFIHGGPPGYAPYCEERLRRTFVNGTRTQPPSWLELQATKSKKPIMLPVTFMDGTTKTLLTDSATTAKELCNALADKISLKDRFGFSLYIALFDKVSSLGSGSDHVMDAISQCEQYAKEQGAQERNAPWRLFFRKEVFTPWHSPSEDNVATNLIYQQVVRGVKFGEYRCEKEDDLAELASQQYFVDYGSEMILERLLNLVPTYIPDREITPLKTLEKWAQLAIAAHKKGIYAQRRTDAQKVKEDVVSYARFKWPLLFSRFYEAYKFSGPSLPKNDVIVAVNWTGVYFVDEQEQVLLELSFPEIMAVSSSRGAKTTAPSFTLATIKGDEYTFTSSNAEDIRDLVVTFLEGLRKRSKYVVALQDNPNPAGEESGFLSFAKGDLIILDHDTGEQVMNSGWANGINERTKQRGDFPTDSVYVMPTVTMPPREIVALVTMTPDQRQDVVRLLQLRTAEPEVRAKPYTLEEFSYDYFRPPPKHTLSRVMVSKARGKDRLWSHTREPLKQALLKKLLGSEELSQEACLAFIAVLKYMGDYPSKRTRSVNELTDQIFEGPLKAEPLKDEAYVQILKQLTDNHIRYSEERGWELLWLCTGLFPPSNILLPHVQRFLQSRKHCPLAIDCLQRLQKALRNGSRKYPPHLVEVEAIQHKTTQIFHKVYFPDDTDEAFEVESSTKAKDFCQNIATRLLLKSSEGFSLFVKIADKVLSVPENDFFFDFVRHLTDWIKKARPIKDGIVPSLTYQVFFMKKLWTTTVPGKDPMADSIFHYYQELPKYLRGYHKCTREEVLQLGALIYRVKFEEDKSYFPSIPKLLRELVPQDLIRQVSPDDWKRSIVAYFNKHAGKSKEEAKLAFLKLIFKWPTFGSAFFEVKQTTEPNFPEILLIAINKYGVSLIDPKTKDILTTHPFTKISNWSSGNTYFHITIGNLVRGSKLLCETSLGYKMDDLLTSYISQMLTAMSKQRGSRSGK

SEQ ID NO: 54666 - protein, 859 aa, Homo sapiens
MGRKLDLSGLTDDETEHVLQVVQRDFNLRKKEEERLSELKQKLDEEGSKCSILSKHQQFVEHCCMRCCSPFTFLVNTKRQCGDCKFNVCKSCCSYQKHEKAWVCCVCQQARLLRAQSLEWFYNNVKSRFKRFGSAKVLKNLYRKHRLESGACFDILGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 54667 - protein, 770 aa, Homo sapiens
MRKAASAASSRSTSSLWSTAACAAARPSPSSSTPSASVEIANSMSARAAAPTRSTKRPGSAASASKRGGSLFESNLENEGSISGSDSTFYRQSEGHSVMDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 54668 - protein, 859 aa, Homo sapiens; identical to SEQ ID NO: 54666

SEQ ID NO: 54669 - protein, 672 aa, Homo sapiens
MDTLAVALRVAEEAIEEAISKAEAYGDSLDKQNEASYLRDHKEELTEELATTILQKIIRKQKSKSEQQVEEEPGWPHPQSCSTKVADEGTSASPGGYRAPAALWRSQSAFSITGEEALKTPPVEAPSRQPRDQGQHPRAESALPSWKSVDRLDETNLAPVLQSPDGNWVALKDGAPPPTRLLAKPKSGTFQALEVASSVASAYDEMGSDSEEDFDWSEALSKLCPRSRALPRNPQPQPTQAQSSDQGPIAASPSSALSPNPEAMCSDSETSSAGSSREVGHQARLSWLQRKAPRNPAAEKMRLHGELDVNFNPQLASRETSDSSEPEEAPHTTDRRARRWRRARLGSEEPSKEPSSPSAQLRDLDTHQVSDDLSETDISNEARDPQTLTDTTEEKRRNRLYELAMKMSEKETSSGEDQESEPKTESENQKESLSSEDNSQSVQEELKKKFSAVSLCNISTEVLKVINATEELIAGSTGPWESPQVPPDRQKGMFPRGTDQVRLDEQLTSLEENVYLAAGTVYGLETQLTELEDAARCIHSGTDETHLADLEDQVATAAAQVHHAELQISDIESRISALTIAGLNIAPCVRFTRRRDQKQRTQVQTIDTSRQQRRKLPAPPVKAEKIETSSVTTIKTFNHNFILQGSSTNRTKERKGTTKDLMEPALESAVMY

SEQ ID NO: 54670 - protein, 961 aa, Homo sapiens
MKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSAFTLPSLLARPPPAQDAGPAGEDAAGTLFPRGHGSGHQQVRALREDLFLHTEPHPPAPGRTAHEVLHWGITRCTGSFSLKPRSTRKGQGSVQPLAGTYLEGSFLCHGRELVAWRVQVVWEGDKGQCLAGADPHSHGSPWISLTGNFSMPFGKSTQQSGTCISGLCQVYSGHHSPLATSPRSTDSITHSADERMSKLKHAEVRWLRVSTWQSRQLISALTFAVSLRCHCTPATSLSAHSQPHTWAAPLSASERPTVVSGLVLALAEQLCVLIRWRGLLVTLSFISREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFATPILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLRE

SEQ ID NO: 54671 - protein, 2117 aa, Homo sapiens
MSGFRLGDHVWLEPPSTHKTGVAIGGIIKEAKPGKVLVEDDEGKEHWIRAEDFGVLSPMHPNSVQGVDDMIRLGDLNEAGMVHNLLIRYQQHKIYTYTGSILVAVNPFQVLPLYTLEQVQLYYSRHMGELPPHVFAIANNCYFSMKRNKRDQCCIISGESGAGKTETTKLILQFLATISGQHSWIEQQVLEANPILEAFGNAKTIRNDNSSRFGKYIDIYFNPSGVIEGARIEQFLLEKSRVCRQAPEERNYHIFYCMLMGVSAEDKQLLSLGTPSEYHYLTMGNCTSCEGLNDAKDYAHIRSAMKILQFSDSESWDVIKLLAAILHLGNVGFMASVFENLDASDVMETPAFPTVMKLLEVQHQELRDCLIKHTILIRGEFVTRSLNIAQAADRRDAFVKGIYGHLFLWIVKKINAAIFTPPAQDPKNVRRAIGLLDIFGFENFENNSFEQLCINFANEHLQQFFVQHVFTMEQEEYRSENISWDYIHYTDNRPTLDLLALKPMSIISLLDEESRFPQGTDLTMLQKLNSVHANNKAFLQPKNIHDARFGIAHFAGEVYYQAEGFLEKNRDVLSTDILTLVYSSKNKFLREIFNLELAETKLGHGTIRQAKAGNHLFKSADSNKRPSTLGSQFKQSLDQLMKILTNCQPYFIRCIKPNEYKKPLLFDRELCLRQLRYSGMMETVHIRKSGFPIRYTFEEFSQRFGVLLPNAMRMQLQGKLRQMTLGITDVWLRTDKDWKAGKTKIFLRDHQDTLLEVQRSQVLDRAALSIQKVLRGYRYRKEFLRQRRAAVTLQAWWRGYCNRRNFKLILVGFERLQAIARSQPLARQYQAMRQRTVQLQALCRGYLVRQQVQAKRRAVVVIQAHARGMAARRNFQQRKANAPLVIPAEGQKSQGALPAKKRRSIYDTVTDTEMVEKVFGFLPAMIGGQEGQASPHFEDLESKTQKLLEVDLDTVPMAEEPEEDVDGLAEYTFPKFAVTYFQKSASHTHIRRPLRYPLLYHEDDTDCLAALVIWNVILRFMGDLPEPVLYARSSQQGSSVMRQIHDTLGREHGAQVPQHSRSAQVASQLNIGEEALEPDGLGADRPMSNLEKVHFIVGYAILRPSLRDEIYCQICKQLSENFKTSSLARGWILLSLCLGCFPPSERFMKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFATPILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLREVSDWVKKNKPQKEGAPVTLPYQVYFMRKLWLNISPGKDVNADTILHYHQELPKYLRGFHKCSREDAIHLAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 54672 - protein, 2116 aa, Homo sapiens
MSGFRLGDHVWLEPPSTHKTGVAIGGIIKEAKPGKVLVEDDEGKEHWIRAEDFGVLSPMHPNSVQGVDDMIRLGDLNEAGMVHNLLIRYQQHKIYTYTGSILVAVNPFQVLPLYTLEQVQLYYSRHMGELPPHVFAIANNCYFSMKRNKRDQCCIISGESGAGKTETTKLILQFLATISGQHSWIEQQVLEANPILEAFGNAKTIRNDNSSRFGKYIDIYFNPSGVIEGARIEQFLLEKSRVCRQAPEERNYHIFYCMLMGVSAEDKQLLSLGTPSEYHYLTMGNCTSCEGLNDAKDYAHIRSAMKILQFSDSESWDVIKLLAAILHLGNVGFMASVFENLDASDVMETPAFPTVMKLLEVQHQELRDCLIKHTILIRGEFVTRSLNIAQAADRRDAFVKGIYGHLFLWIVKKINAAIFTPPAQDPKNVRRAIGLLDIFGFENFENNSFEQLCINFANEHLQQFFVQHVFTMEQEEYRSENISWDYIHYTDNRPTLDLLALKPMSIISLLDEESRFPQGTDLTMLQKLNSVHANNKAFLQPKNIHDARFGIAHFAGEVYYQAEGFLEKNRDVLSTDILTLVYSSKNKFLREIFNLELAETKLGHGTIRQAKAGNHLFKSADSNKRPSTLGSQFKQSLDQLMKILTNCQPYFIRCIKPNEYKKPLLFDRELCLRQLRYSGMMETVHIRKSGFPIRYTFEEFSQRFGVLLPNAMRMQLQGKLRQMTLGITDVWLRTDKDWKAGKTKIFLRDHQDTLLEVQRSQVLDRAALSIQKVLRGYRYRKEFLRQRRAAVTLQAWWRGYCNRRNFKLILVGFERLQAIARSQPLARQYQAMRQRTVQLQALCRGYLVRQQVQAKRRAVVVIQAHARGMAARRNFQQRKANAPLVIPAEGQKSQGALPAKKRRSIYDTVTDTEMVEKVFGFLPAMIGGQEGQASPHFEDLESKTQKLLEVDLDTVPMAEEPEEDVDGLAEYTFPKFAVTYFQKSASHTHIRRPLRYPLLYHEDDTDCLAALVIWNVILRFMGDLPEPVLYARSSQQGSSVMRQIHDTLGREHGAQVPQHSRSAQVASQLNIGEEALEPDGLGADRPMSNLEKVHFIVGYAILRPSLRDEIYCQICKQLSENFKTSSLARGWILLSLCLGCFPPSERFMKYLLNFIGQGPATYGPFCAERLRRTYANGVRAEPPTWLELQAVKSKKHIPIQVILATGESLTVPVDSASTSREMCMHIAHKQGLSDHLGFSLQVAVYDKFWSLGSGRDHMMDAIARCEQMAQERGESQRQSPWRIYFRKEFFTPWHDSREDPVSTELIYRQVLRGVWSGEYSFEKEEELVELLARHCYVQLGASAESKAVQELLPSCIPHKLYRTKPPDRWASLVTAACAKAPYTQKQVTPLAVREQVVDAARLQWPLLFSRLFEVITLSGPRLPKTQLILAVNWKGLCFLDQQEKMLLELSFPEVMGLATNREAQGGQRLLLSTMHEEYEFVSPSSVAIAELVALFLEGLKERSIFAMALQDRKATDDTTLLAFKKGDLLVLTKKQGLLASENWTLGQNDRTGKTGLVPMACLYTIPTVTKPSAQLLSLLAMSPEKRKLAAQEGQFTEPRPEEPPKEKLHTLEEFSYEFFRAPEKDMVSMAVLPLARARGHLWAYSCEPLRQPLLKRVHANVDLWDIACQIFVAILRYMGDYPSRQAWPTLELTDQIFTLALQHPALQDEVYCQILKQLTHNSNRHSEERGWQLLWLCTGLFPPSKGLLPHAQKFIDTRRGKLLAPDCSRRIQKVLRTGPRKQPPHQVEVEAAEQNVSRICHKIYFPNDTSEMLEVVANTRVRDVCDSIATRLQLASWEGCSLFIKISDKVISQKEGDFFFDSLREVSDWVKKNKPQKEGAPVTLPYQVYFMRKLWLNISPGKDVNADTILHYHQELPKYLRGFHKCSREDAIHLAGLIYKAQFNNDRSQLASVPKILRELVPENLTRLMSSEEWKKSILLAYDKHKDKTVEEAKVAFLKWICRWPTFGSAFFEVKQTSEPSYPDVILIAINRHGVLLIHPKTKDLLTTYPFTKISSWSSGSTYFHMALGSLGRGSRLLCETSLGYKMDDLLTSYVQQLLSAMNKQRGSKAPALAST

SEQ ID NO: 54673 - protein, 2116 aa, Homo sapiens; identical to SEQ ID NO: 54672

SEQ ID NO: 54674 - protein, 1415 aa, Homo sapiens
MPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 54675 - protein, 1415 aa, Homo sapiens; identical to SEQ ID NO: 54674

SEQ ID NO: 54676 - protein, 1397 aa, Homo sapiens
MLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 54677 - protein, 2058 aa, Homo sapiens
MDNFFTEGTRVWLRENGQHFPSTVNSCAEGIVVFRTDYGQVFTYKQSTITHQKVTAMHPTNEEGVDDMASLTELHGGSIMYNLFQRYKRNQIYTYIGSILASVNPYQPIAGLYEPATMEQYSRRHLGELPPHIFAIANECYRCLWKRHDNQCILISGESGAGKTESTKLILKFLSVISQQSLELSLKEKTSCVERAILESSPIMEAFGNAKTVYNNNSSRFGKFVQLNICQKGNIQGGRIVDYLLEKNRVVRQNPGERNYHIFYALLAGLEHEEREEFYLSTPENYHYLNQSGCVEDKTISDQESFREVITAMDVMQFSKEEVREVSRLLAGILHLGNIEFITAGGAQVSFKTALGRSAELLGLDPTQLTDALTQRSMFLRGEEILTPLNVQQAVDSRDSLAMALYACCFEWVIKKINSRIKGNEDFKSIGILDIFGFENFEVNHFEQFNINYANEKLQEYFNKHIFSLEQLEYSREGLVWEDIDWIDNGECLDLIEKKLGLLALINEESHFPQATDSTLLEKLHSQHANNHFYVKPRVAVNNFGVKHYAGEVQYDVRGILEKNRDTFRDDLLNLLRESRFDFIYDLFEHVSSRNNQDTLKCGSKHRRPTVSSQFKDSLHSLMATLSSSNPFFVRCIKPNMQKMPDQFDQAVVLNQLRYSGMLETVRIRKAGYAVRRPFQDFYKRYKVLMRNLALPEDVRGKCTSLLQLYDASNSEWQLGKTKVFLRESLEQKLEKRREEEVSHAAMVIRAHVLGFLARKQYRKVLYCVVIIQKNYRAFLLRRRFLHLKKAAIVFQKQLRGQIARRVYRQLLAEKREQEEKKKQEEEEKKKREEEERERERERREAELRAQQEEETRKQQELEALQKSQKEAELTRELEKQKENKQVEEILRLEKEIEDLQRMKEQQELSLTEASLQKLQERRDQELRRLEEEACRAAQEFLESLNFDEIDECVRNIERSLSVGSEFSSELAESACEEKPNFNFSQPYPEEEVDEGFEADDDAFKDSPNPSEHGHSDQRTSGIRTSDDSSEEDPYMNDTVVPTSPSADSTVLLAPSVQDSGSLHNSSSGESTYCMPQNAGDLPSPDGDYDYDQDDYEDGAITSGSSVTFSNSYGSQWSPDYRCSVGTYNSSGAYRFSSEGAQSSFEDSEEDFDSRFDTDDELSYRRDSVYSCVTLPYFHSFLYMKGGLMNSWKRRWCVLKDETFLWFRSKQEALKQGWLHKKGGGSSTLSRRNWKKRWFVLRQSKLMYFENDSEEKLKGTVEVRTAKEIIDNTTKENGIDIIMADRTFHLIAESPEDASQWFSVLSQVHASTDQEIQEMHDEQANPQNAVGTLDVGLIDSVCASDSPDRPNSFVIITANRVLHCNADTPEEMHHWITLLQRSKGDTRVEGQEFIVRGWLHKEVKNSPKMSSLKLKKRWFVLTHNSLDYYKSSEKNALKLGTLVLNSLCSVVPPDEKIFKETGYWNVTVYGRKHCYRLYTKLLNEATRWSSAIQNVTDTKAPIDTPTQQLIQDIKENCLNSDVVEQIYKRNPILRYTHHPLHSPLLPLPYGDINLNLLKDKGYTTLQDEAIKIFNSLQQLESMSDPIPIIQGILQTGHDLRPLRDELYCQLIKQTNKVPHPGSVGNLYSWQILTCLSCTFLPSRGILKYLKFHLKRIREQFPGSEMEKYALFTYESLKKTKCREFVPSRDEIEALIHRQEMTSTVYCHGGGSCKITINSHTTAGEVVEKLIRGLAMEDSRNMFALFEYNGHVDKAIESRTVVADVLAKFEKLAATSEVGDLPWKFYFKLYCFLDTDNVPKDSVEFAFMFEQAHEAVIHGHHPAPEENLQVLAALRLQYLQGDYTLHAAIPPLEEVYSLQRLKARISQSTKTFTPCERLEKRRTSFLEGTLRRSFRTGSVVRQKVEEEQMLDMWIKEEVSSARASIIDKWRKFQGMNQEQAMAKYMALIKEWPGYGSTLFDVECKEGGFPQELWLGVSADAVSVYKRGEGRPLEVFQYEHILSFGAPLANTYKIVVDERELLFETSEVVDVAKLMKAYISMIVKKRYSTTRSASSQGSSR

SEQ ID NO: 54678 - protein, 1397 aa, Homo sapiens; identical to SEQ ID NO: 54676

SEQ ID NO: 54679 - protein, 3530 aa, Homo sapiens
MAKEEDEEKKAKKGKKGKKAPEPEKPKRSLKGTSRLFMGFRDRTPKISKKGQFRSASAFFWGLHTGPQKTKRKRKARTVLKSTSKLMTQMRMGKKKRAMKGKKPSFMVIRFPGRRGYGRLRPRARSLSKASTAINWLTKKFLLKKAEESGSEQATVDAWLQRSSSRMGSRKLPFPSGAEILRPGGRLRRFPRSRSIYASGEPLGFLPFEDEAPFHHSGSRKSLYGLEGFQDLGEYYDYHRDGDDYYDRQSLHRYEEQEPYLAGLGPYSPAWPPYGDHYYGYPPEDPYDYYHPDYYGGPFDPGYTYGYGYDDYEPPYAPPSGYSSPYSYHDGYEGEAHPYGYYLDPYAPYDAPYPPYDLPYHTPYDVPYFDPYGVHYTVPYAEGVYGGGDEAIYPPEVPYFYPEESASAFVYPWVPPPIPSPHNPYAHAMDDIAELEEPEDAGVERQGTSFRLPSAAFFEQQGMDKPARSKLSLIRKFRLFPRPQVKLFGKEKLEVPLPPSLDIPLPLGDADEEEDEEELPPVSAVPYGHPFWGFLTPRQRNLQRALSAFGAHRGLGFGPEFGRPVPRPATSLARFLKKTLSEKKPIARLRGSQKARAGGPAVREAAYKRFGYKLAGMDPEKPGTPIVLRRAQPRARSSNDARRPPAPQPAPRTLSHWSALLSPPVPPRPPSSGPPPAPPLSPALSGLPRPASPYGSLRRHPPPWAAPAHVPPAPQASWWAFVEPPAVSPEVPPDLLAFPGPRPSFRGSRRRGAAFGFPGASPRASRRRAWSPLASPQPSLRSSPGLGYCSPLAPPSPQLSLRTGPFQPPFLPPARRPRSLQESPAPRRAAGRLGPPGSPLPGSPRPPSPPLGLCHSPRRSSLNLPSRLPHTWRRLSEPPTRAVKPQVRLPFHRPPRAGAWRAPLEHRESPREPEDSETPWTVPPLAPSWDVDMPPTQRPPSPWPGGAGSRRGFSRPPPVPENPFLQLLGPVPSPTLQPEDPAADMTRVFLGRHHEPGPGQLTKSAGPTPEKPEEEATLGDPQLPAETKPPTPAPPKDVTPPKDITPPKDVLPEQKTLRPSLSYPLAACDQTRATWPPWHRWGTLPQAAAPLAPIRAPEPLPKGGERRQAAPGRFAVVMPRVQKLSSFQRVGPATLKPQVQPIQDPKPRACSLRWSCLWLRADAYGPWPRVHTHPQSCHLGPGAACLSLRGSWEEVGPPSWRNKMHSIRNLPSMRFREQHGEDGVEDMTQLEDLQETTVLSNLKIRFERNLIYTYIGSILVSVNPYQMFGIYGPEQVQQYNGRALGENPPHLFAVANLAFAKMLDAKQNQCIIISGESGSGKTEATKLILRYLAAMNQKREVMQQIKILEATPLLESFGNAKTVRNDNSSRFGKFVEIFLEGGVISGAITSQYLLEKSRIVFQAKNERNYHIFYELLAGLPAQLRQAFSLQEAETYYYLNQGGNCEIAGKSDADDFRRLLAAMEVLGFSSEDQDSIFRILASILHLGNVYFEKYETDAQEVASVVSAREIQAVAELLQISPEGLQKAITFKVTETMREKIFTPLTVESAVDARDAIAKVLYALLFSWLITRVNALVSPRQDTLSIAILDIYGFEDLSFNSFEQLCINYANENLQYLFNKIVFQEEQEEYIREQIDWQEITFADNQPCINLISLKPYGILRILDDQCCFPQATDHTFLQKCHYHHGANPLYSKPKMPLPEFTIKHYAGKVTYQVHKFLDKNHDQVRQDVLDLFVRSRTRVVAHLFSSHAPQAAPQRLGKSSSVTRLYKAHTVAAKFQQSLLDLVEKMERCNPLFMRCLKPNHKKEPGLFEPDVVMAQLRYSGVLETVRIRKEGFPVRLPFQGFIDRYCCLVALKHDLPANGDMCVSVLSRLCKVMPNMYRVGVSKLFLKEHLYQLLESMREHVLNLAALTLQRCLRGFFIKRRFRSLRHKIILLQSRARGYLARQRYQQMRRSLVKFRSLVHAYVSRRRYLKLRAEWRCQVEGALLWEQEELSKREVVAVGHLEVPAELAGLLQAVAGLGLAQVPQVAPVRTPRLQAEPRVTLPLDINNYPMAKFVQCHFKEPAFGMLTVPLRTPLTQLPAEHHAEAVSIFKLILRFMGDPHLHGARENIFGNYIVQKGLAVPELRDEILAQLANQVWHNHNAHNAERGWLLLAACLSGFAPSPCFNKYLLKFVSDYGRNGFQAVCQHRLMQAMGRAQQQGSGAARTLPPTQLEWTATYEKASMALDVGCFNGDQFSCPVHSWSTGEEVAGDILRHRGLADGWRGWTVAMKNGVQWAELAGHDYVLDLVSDLELLRDFPRQKSYFIVGTEGPAASRGGPKVVFGNSWDSDEDMSTRPQPQEHMPKVLDSDGYSSHNQDGTNGETEAQRGTATHQESDSLGEPAVPHKGLDCYLDSLFDPVLSYGDADLEKPTAIAYRMKGGGQPGGGSSSGTEDTPRRPPEPKPIPGLDASTLALQQAFIHKQAVLLAREMTLQATALQQQPLSAALRSLPAEKPPAPEAQPTSVGTGPPAKPVLLRATPKPLAPAPLAKAPRLPIKPVAAPVLAQDQASPETTSPSPELVRYSTLNSEHFPQPTQQIKNIVRQYQQPFRGGRPEALRKDGGKVFMKRPDPHEEALMILKGQMTHLAAAPGTQVSREAVALVKPVTSAPRPSMAPTSALPSRSLEPPEELTQTRLHRLINPNFYGYQDAPWKIFLRKEVFYPKDSYSHPVQLDLLFRQILHDTLSEACLRISEDERLRMKALFAQNQLDTQKPLVTESVKRAVVSTARDTWEVYFSRIFPATGSVGTGVQLLAVSHVGIKLLRMVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGWRFGTIHGRVGRFPSELVQPAAAPDFLQLPTEPGRGRAAAVAAAVASAAAAQEVGRRREGPPVRARSADHGEDALALPPYTMLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHELMVKFPLKEIQSTRTQRPTANSSYPYVEIALGDVAAQRTLQLQLEQGLELCRVVAVHVENLLSAHEKRLTLPPSEITLL

SEQ ID NO: 54680 - protein, 478 aa, Homo sapiens
MLEFAQKYFRDPQRRPQDGLRLKSKEPRESRTLEDMLCFTKTPLQESLIELSDSSLSKMATDMFLAVMRFMGDAPLKGQSDLDVLCNLLKLCGDHEVMRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGQHVCPLSRRAYILDVASEMEQVDGGYMLWFRRVLWDQPLKFENELYVTMHYNQVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHVSGLSLALPSPPSVPWSPTPSKRPRPPAAEAQFHCLPPS

SEQ ID NO: 54681 - protein, 184 aa, Homo sapiens
MNMLSSLSPTVVLPDYLKGLFSSVPASRPSEQLLQQVSKLASLQHRAKDHFYLPSVREVQEYIPAQLYRTTAGSTWLNLVSQHRQQTQALSPHQARAQFLGLLSALPMFGSSFFFIQSCSNIAVPAPCILAINHNGLNFLSTETHVSGLSLALPSPPSVPWSPTPSKRPRPPAAEAQFHCLPPS

SEQ ID NO: 54682 - protein, 244 aa, Homo sapiens
MRDECYCQVVKQITDNTSSKQDSCQRGWRLLYIVTAYHSCSEVLHPHLTRFLQDVSRTPGLPFQGIAKACEQNLQKTLRFGGRLELPSSIELRAMLAGRSSKRQLFLLPGGLERHLKIKTCTVALDVVEEICAEMALTRPEAFNEYVIFVVTNRGGKSRSTSQPSSTVQRQARPGSTWSASTGSRHRRSAPTRPVPSFWASSAPYLCSAPPSSSSRAAATLLCQPLASLPSTTMASTFSAQRLM

SEQ ID NO: 54683 - protein, 142 aa, Homo sapiens
MVKGGQEAGGQLRVLRAYSFADILFVTMPSQNMLEFNLASEKVILFSARAHQVKTLVDDFILELKKDSDYVVAVRNFLPEDPALLAFHKGDIIHLQPLEPPRVGYSAGCVVRRKVVYLEELRRRGPDFGVCPRTWNPIRGAS

SEQ ID NO: 54684 - protein, 2054 aa, Homo sapiens
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKVHSTAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSLQDMVTKYQKRKNKLEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54685 - protein, 2002 aa, Homo sapiens
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKVHSTAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54686 - protein, 1642 aa, Homo sapiens
MEGPRTTKLEGSSKEGSGPSRSPQPPTSPIPPETSQRARSPAPTLAMNGPGAATAEGLSEEAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54687 - protein, 2054 aa, Homo sapiens
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSLQDMVTKYQKRKNKLEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54688 - protein, 935 aa, Homo sapiens
MRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54689 - protein, 2039 aa, Homo sapiens
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQAKLRLEMEMERMRQTHSKEMESRDEEVEEARQSCQKKLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54690 - protein, 2002 aa, Homo sapiens
MFNLMKKDKDKDGGRKEKKEKKEKKERMSAAELRSLEEMSLRRGFFNLNRSSKRESKTRLEISNPIPIKVASGSDLHLTDIDSDSNRGSVILDSGHLSTASSSDDLKGEEGSFRGSVLQRAAKFGSLAKQNSQMIVKRFSFSQRSRDESASETSTPSEHSAAPSPQVEVRTLEGQLVQHPGPGIPRPGHRSRAPELVTKKFPVDLRLPPVVPLPPPTLRELELQRRPTGDFGFSLRRTTMLDRGPEGQACRRVVHFAEPGAGTKDLALGLVPGDRLVEINGHNVESKSRDEIVEMIRQSGDSVRLKVQPIPELSELSRSWLRSGEGPRREPSDAKTEEQIAAEEAWNETEKVWLVHRDGFSLASQLKSEELNLPEGKVRVKLDHDGAILDVDEDDVEKANAPSCDRLEDLASLVYLNESSVLHTLRQRYGASLLHTYAGPSLLVLGPRGAPAVYSEKVMHMFKGCRREDMAPHIYAVAQTAYRAMLMSRQDQSIILLGSSGSGKTTSCQHLVQYLATIAGISGNKVFSVEKWQALYTLLEAFGNSPTIINGNATRFSQILSLDFDQAGQVASASIQTMLLEKLRVARRPASEATFNVFYYLLACGDGTLRTELHLNHLAENNVFGIVPLAKPEEKQKAAQQFSKLQAAMKVLGISPDEQKACWFILAAIYHLGAAGATKEAAEAGRKQFARHEWAQKAAYLLGCSLEELSSAIFKHQHKGGTLQRSTSFRQGPEESGLGDGTGPKLSALECLEGMAAGLYSELFTLLVSLVNRALKSSQHSLCSMMIVDTPGFQNPEQGGSARGASFEELCHNYTQDRLQRLFHERTFVQELERYKEENIELAFDDLEPPTDDSVAAVDQASHQSLVRSLARTDEARGLLWLLEEEALVPGASEDTLLERLFSYYGPQEGDKKGQSPLLHSSKPHHFLLGHSHGTNWVEYNVTGWLNYTKQNPATQNAPRLLQDSQKKIISNLFLGRAGSATVLSGSIAGLEGGSQLALRRATSMRKTFTTGMAAVKKKSLCIQMKLQVDALIDTIKKSKLHFVHCFLPVAEGWAGEPRSASSRRVSSSSELDLPSGDHCEAGLLQLDVPLLRTQLRGSRLLDAMRMYRQGYPDHMVFSEFRRRFDVLAPHLTKKHGRNYIVVDERRAVEELLECLDLEKSSCCMGLSRVFFRAGTLARLEEQRDEQTSRNLTLFQAACRGYLARQHFKKRKIQDLAIRCVQKNIKKNKGVKDWPWWKLFTTVRPLIEVQLSEEQIRNKDEEIQQLRSKLEKAEKERNELRLNSDRLESRISELTSELTDERNTGESASQLLDAETAERLRAEKEMKELQTQYDALKKQMEVMEMEVMEARLIRAAEINGEVDDDDAGGEWRLKYERAVREVDFTKKRLQQEFEDKLEVEQQNKRQLERRLGDLQADSEESQRALQQLKKKCQRLTAELQDTKLHLEGQQVRNHELEKKQRRFDSELSQAHEEAQREKLQREKLQREKDMLLAEAFSLKQQLEEKDMDIAGFTQKVVSLEAELQDISSQESKDEASLAKVKKQLRDLEAKVKDQEEELDEQAGTIQMLEQLKQMEVQLEEEYEDKQKVLREKRELEGKLATLSDQVNRRDFESEKRLRKDLKRTKALLADAQLMLDHLKNSAPSKREIAQLKNQLEESEFTCAAAVKARKAMEVEIEDLHLQIDDIAKAKTALEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54691 - protein, 935 aa, Homo sapiens; identical to SEQ ID NO: 54688

SEQ ID NO: 54692 - protein, 320 aa, Homo sapiens
MTFVLLSSSQLEEQLSRLQREKNEIQNRLEEDQEDMNELMKKHKAAVAQASRDLAQINDLQAQLEEANKEKQELQEKLQALQSQVEFLEQSMVDKSLVSRQEAKIRELETRLEFERTQVKRLESLASRLKENMEKLTEERDQRIAAENREKEQNKRLQRQLRDTKEEMGELARKEAEASRKKHELEMDLESLEAANQSLQADLKLAFKRIGDLQAAIEDEMESDENEDLINSEGDSDVDSELEDRVDGVKSWLSKNKGPSKAASDDGSLKSSSPTSYWKSLAPDRSDDEHDPLDNTSRPRYSHSYLSDSDTEAKLTETNA

SEQ ID NO: 54693 - protein, 2567 aa, Homo sapiens
MAISSRLALWEQKIREEDKSPPPSSPPPLFSVIPGGFIKQLVRGTEKEAKEARQRKQLAVASPEREIPEISISQPNSKSSSGTRSGSQQISQDDQSSSPGSSDILGKESEGSRSPDPEQMTSINGEKAQELGSSATPTKKTVPFKRGVRRGDVLLMVAKLDPDSAKPEKTHPHDAPPCKTSPPATDTGKEKKGETSRTPCGSQASTEILAPKAEKTRTGGLGDPGQGTVALKKGEEGQSIVGKGLGTPKTTELKEAEPQGKDRQGTRPQAQGPGEGVRPGKAEKEGAEPTNTVEKGNVSKDVGSEGKHVRPQIPGRKWGGFLGRRSKWDGPQNKKDKEGVLLSKAEKTGEPQTQMEKTSQVQGELGDDLRMGEKAGELRSTTGKAGESWDKKEKMGQPQGKSGNAGEARSQTEKGCEAPKEVSTMVESPAAPGKGGWPGSRGQEAEEPCSRAGDGAGALETELEGPSQPALEKDAERPRIRKENQDGPAPQEEGKGGQSRDSDQAPEDRWYEAEKVWLAQKDGFTLATVLKPDEGTADLPAGRVRLWIDADKTITEVDEEHVHRANPPELDQVEDLASLISVNESSVLNTLLQRYKAQLLHTCTGPDLIVLQPRGPSVPSAGKVPKGRRDGLPAHIGSMAQRAYWALLNQRRDQSIVALGWSGAGKTTCCEQVLEHLVGMAGSVDGRVSVEKIRATFTVLRAFGSVSMAHSRSATRFSMVMSLDFNATGRITAAQLQTMLLEKSRVARQPEGESNFLVFSQMLAGLDLDLRTELNLHQMADSSSFGMGVWSKPEDKQKAAAAFAQLQGAMEMLGISESEQRAVWRVLAAIYHLGAAGACKVGRKQFMRFEWANYAAEALGCEYEELNTATFKHHLRQIIQQMTFGPSRWGLEDEETSSGLKMTGVDCVEGMASGLYQELFAAVVSLINRSFSSHHLSMASIMVVDSPGFQNPRHQGKDRAATFEELCHNYAHERLQLLFYQRTFVSTLQRYQEEGVPVQFDLPDPSPGTTVAVVDQNPSQVRLPAGGGAQDARGLFWVLDEEVHVEGSSDSVVLERLCAAFEKKGAGTEGSSALRTCEQPLQCEIFHQLGWDPVRYDLTGWLHRAKPNLSALDAPQVLHQSKREELRSLFQARAKLPPVCRAVAGLEGTSQQALQRSRMVRRTFASSLAAVRRKAPCSQIKLQMDALTSMIKRSRLHFIHCLVPNPVVESRSGQESPPPPQPGRDKPGAGGPLALDIPALRVQLAGFHILEALRLHRTGYADHMGLTRFRRQFQVLDAPLLKKLMSTSEGIDERKAVEELLETLDLEKKAVAVGHSQVFLKAGVISRLEKQREKLVSQSIVLFQAACKGFLSRQEFKKLKIRRLAAQCIQKNVAVFLAVKDWPWWQLLGSLQPLLSATIGTEQLRAKEEELTTLRRKLEKSEKLRNELRQNTDLLESKIADLTSDLADERFKGDVACQVLESERAERLQAFREVQELKSKHEQVQKKLGDVNKQLEEAQQKIQLNDLERNPTGGADEWQMRFDCAQMENEFLRKRLQQCEERLDSELTARKELEQKLGELQSAYDGAKKMAHQLKRKCHHLTCDLEDTCVLLENQQSRNHELEKKQKKFDLQLAQALGESVFEKGLREKVTQENTSVRWELGQLQQQLKQKEQEASQLKQQVEMLQDHKRELLGSPSLGENCVAGLKERLWKLESSALEQQKIQSQQENTIKQLEQLRQRFELEIERMKQMHQKDREDQEEELEDVRQSCQKRLHQLEMQLEQEYEEKQMVLHEKQDLEGLIGTLCDQIGHRDFDVEKRLRRDLRRTHALLSDVQLLLGTMEDGKTSVSKEELEKVHSQLEQSEAKCEEALKTQKVLTADLESMHSELENMTRNKSLVDEQLYRLQFEKADLLKRIDEDQDDLNELMQKHKDLIAQSAADIGQIQELQLQLEEAKKEKHKLQEQLQVAQMRIEYLEQSTVDRAIVSRQEAVICDLENKTEFQKVQIKRFEVLVIRLRDSLIKMGEELSQAATSESQQRESSQYYQRRLEELKADMEELVQREAEASRRCMELEKYVEELAAVRQTLQTDLETSIRRIADLQAALEEVASSDSDTESVQTAVDCGSSGRKEMDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 54694 - protein, 2568 aa, Homo sapiens
MAISSRLALWEQKIREEDKSPPPSSPPPLFSVIPGGFIKQLVRGTEKEAKEARQRKQLAVASPEREIPEISISQPNSKSSSGTRSGSQQISQDDQSSSPGSSDILGKESEGSRSPDPEQMTSINGEKAQELGSSATPTKKTVPFKRGVRRGDVLLMVAKLDPDSAKPEKTHPHDAPPCKTSPPATDTGKEKKGETSRTPCGSQASTEILAPKAEKTRTGGLGDPGQGTVALKKGEEGQSIVGKGLGTPKTTELKEAEPQGKDRQGTRPQAQGPGEGVRPGKAEKEGAEPTNTVEKGNVSKDVGSEGKHVRPQIPGRKWGGFLGRRSKWDGPQNKKDKEGVLLSKAEKTGEPQTQMEKTSQVQGELGDDLRMGEKAGELRSTTGKAGESWDKKEKMGQPQGKSGNAGEARSQTEKGCEAPKEVSTMVESPAAPGKGGWPGSRGQEAEEPCSRAGDGAGALETELEGPSQPALEKDAERPRIRKENQDGPAPQEEGKGGQSRDSDQAPEDRWYEAEKVWLAQKDGFTLATVLKPDEGTADLPAGRVRLWIDADKTITEVDEEHVHRANPPELDQVEDLASLISVNESSVLNTLLQRYKAQLLHTCTGPDLIVLQPRGPSVPSAGKVPKGRRDGLPAHIGSMAQRAYWALLNQRRDQSIVALGWSGAGKTTCCEQVLEHLVGMAGSVDGRVSVEKIRATFTVLRAFGSVSMAHSRSATRFSMVMSLDFNATGRITAAQLQTMLLEKSRVARQPEGESNFLVFSQMLAGLDLDLRTELNLHQMADSSSFGMGVWSKPEDKQKAAAAFAQLQGAMEMLGISESEQRAVWRVLAAIYHLGAAGACKVGRKQFMRFEWANYAAEALGCEYEELNTATFKHHLRQIIQQMTFGPSRWGLEDEETSSGLKMTGVDCVEGMASGLYQELFAAVVSLINRSFSSHHLSMASIMVVDSPGFQNPRHQGKDRAATFEELCHNYAHERLQLLFYQRTFVSTLQRYQEEGVPVQFDLPDPSPGTTVAVVDQNPSQQVRLPAGGGAQDARGLFWVLDEEVHVEGSSDSVVLERLCAAFEKKGAGTEGSSALRTCEQPLQCEIFHQLGWDPVRYDLTGWLHRAKPNLSALDAPQVLHQSKREELRSLFQARAKLPPVCRAVAGLEGTSQQALQRSRMVRRTFASSLAAVRRKAPCSQIKLQMDALTSMIKRSRLHFIHCLVPNPVVESRSGQESPPPPQPGRDKPGAGGPLALDIPALRVQLAGFHILEALRLHRTGYADHMGLTRFRRQFQVLDAPLLKKLMSTSEGIDERKAVEELLETLDLEKKAVAVGHSQVFLKAGVISRLEKQREKLVSQSIVLFQAACKGFLSRQEFKKLKIRRLAAQCIQKNVAVFLAVKDWPWWQLLGSLQPLLSATIGTEQLRAKEEELTTLRRKLEKSEKLRNELRQNTDLLESKIADLTSDLADERFKGDVACQVLESERAERLQAFREVQELKSKHEQVQKKLGDVNKQLEEAQQKIQLNDLERNPTGGADEWQMRFDCAQMENEFLRKRLQQCEERLDSELTARKELEQKLGELQSAYDGAKKMAHQLKRKCHHLTCDLEDTCVLLENQQSRNHELEKKQKKFDLQLAQALGESVFEKGLREKVTQENTSVRWELGQLQQQLKQKEQEASQLKQQVEMLQDHKRELLGSPSLGENCVAGLKERLWKLESSALEQQKIQSQQENTIKQLEQLRQRFELEIERMKQMHQKDREDQEEELEDVRQSCQKRLHQLEMQLEQEYEEKQMVLHEKQDLEGLIGTLCDQIGHRDFDVEKRLRRDLRRTHALLSDVQLLLGTMEDGKTSVSKEELEKVHSQLEQSEAKCEEALKTQKVLTADLESMHSELENMTRNKSLVDEQLYRLQFEKADLLKRIDEDQDDLNELMQKHKDLIAQSAADIGQIQELQLQLEEAKKEKHKLQEQLQVAQMRIEYLEQSTVDRAIVSRQEAVICDLENKTEFQKVQIKRFEVLVIRLRDSLIKMGEELSQAATSESQQRESSQYYQRRLEELKADMEELVQREAEASRRCMELEKYVEELAAVRQTLQTDLETSIRRIADLQAALEEVASSDSDTESVQTAVDCGSSGRKEMDNVSILSSQPEGSLQSWLSCTLSLATDTMRTPSRQSATSSRILSPRINEEAGDTERTQSALALSRARSTNVHSKTSGDKPVSPHFVRRQKYCHFGDGEVLAVQRKSTERLEPASSPLASRSTNTSPLSREKLPSPSAALSEFVEGLRRKRAQRGQGSTLGLEDWPTLPIYQTTGASTLRRGRAGSDEGNLSLRVGAKSPLEIEGAAGGLLRSTSLKCISSDGVGGTTLLPEKSKTQFSSCESLLESRPSMGRKLSSPTTPRDMLLSPTLRPRRRCLESSVDDAGCPDLGKEPLVFQNRQFAHLMEEPLGSDPFSWKLPSLDYERKTKVDFDDFLPAIRKPQTPTSLAGSAKGGQDGSQRSSIHFETEEANRSFLSGIKTILKKSPEPKEDPAHLSDSSSSSGSIVSFKSADSIKSRPGIPRLAGDGGERTSPERREPGTGRKDDDVASIMKKYLQK

SEQ ID NO: 54695 - protein, 2567 aa, Homo sapiens; identical to SEQ ID NO: 54693

SEQ ID NO: 54696 - protein, 1939 aa, Homo sapiens
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYEQHLGKSNNFQKPKPAKGKPEAHFSLIHYAGTVDYNIAGWLDKNKDPLNETVVGLYQKSAMKTLALLFVGATGAEAEAGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIDIDHTQYKFGHTKVFFKAGLLGLLEEMRDEKLAQLITRTQAMCRGFLARVEYQKMVERRESIFCIQYNVRAFMNVKHWPWMKLYFKIKPLLKSAETEKEMANMKEEFEKTKEELAKTEAKRKELEEKMVTLMQEKNDLQLQVQAEADSLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKIRMDLERAKRKLEGDLKLAQESTMDIENDKQQLDEKLKKKEFEMSGLQSKIEDEQALGMQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNMETVSKAKGNLEKMCRALEDQLSEIKTKEEEQQRLINDLTAQRARLQTESGEYSRQLDEKDTLVSQLSRGKQAFTQQIEELKRQLEEEIKAKSALAHALQSSRHDCDLLREQYEEEQEAKAELQRAMSKANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVEQEKSELQAALEEAEASLEHEEGKILRIQLELNQVKSEVDRKIAEKDEEIDQMKRNHIRIVESMQSTLDAEIRSRNDAIRLKKKMEGDLNEMEIQLNHANRMAAEALRNYRNTQAILKDTQLHLDDALRSQEDLKEQLAMVERRANLLQAEIEELRATLEQTERSRKIAEQELLDASERVQLLHTQNTSLINTKKKLETDISQIQGEMEDIIQEARNAEEKAKKAITDAAMMAEELKKEQDTSAHLERMKKNLEQTVKDLQHRLDEAEQLALKGGKKQIQKLEARVRELEGEVESEQKRNVEAVKGLRKHERKVKELTYQTEEDRKNILRLQDLVDKLQAKVKSYKRQAEEAEEQSNVNLSKFRRIQHELEEAEERADIAESQVNKLRVKSREVHTKIISEE

SEQ ID NO: 54697 - protein, 627 aa, Homo sapiens
MSSDSEMAIFGEAAPFLRKSERERIEAQNKPFDAKTSVFVVDPKESFVKATVQSREGGKVTAKTEAGATVTVKDDQVFPMNPPKYDKIEDMAMMTHLHEPAVLYNLKERYAAWMIYTYSGLFCVTVNPYKWLPVYNAEVVTAYRGKKRQEAPPHIFSISDNAYQFMLTDRENQSILITGESGAGKTVNTKRVIQYFATIAVTGEKKKEEVTSGKMQGTLEDQIISANPLLEAFGNAKTVRNDNSSRFGKFIRIHFGTTGKLASADIETYLLEKSRVTFQLKAERSYHIFYQIMSNKKPDLIEMLLITTNPYDYAFVSQGEITVPSIDDQEELMATDSAIEILGFTSDERVSIYKLTGAVMHYGNMKFKQKQREEQAEPDGTEVADKAAYLQNLNSADLLKALCYPRVKVGNEYVTKGQTVQQVYNAVGALAKAVYDKMFLWMVTRINQQLDTKQPRANSEVAQWRTKYETDAIQRTEELEEAKKKLAQRLQDAEEHVEAVNAKCASLEKTKQRLQNEVEDLMIDVERTNAACAALDKKQRNFDKILAEWKQKCEETHAELEASQKESRSLSTELFKIKNAYEESLDQLETLKRENKNLQQEISDLTEQIAEGGKRIHELEKIKKQVE

SEQ ID NO: 54698 - protein, 1972 aa, Homo sapiens
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 54699 - protein, 1938 aa, Homo sapiens
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 54700 - protein, 2029 aa, Homo sapiens
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITEGPSFWRGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPHRKLRSDAPGEETRPLSFLLEGLEDVELLKMQMVLRRKRTLETQTSMEPRPVNKQLSTVLHHGKKTKNQNKQTKKTQQQPRTKQNPADCT

SEQ ID NO: 54701 - protein, 1979 aa, Homo sapiens
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITQGPSFAYGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRRGNETSFVPSRRSGGRRVIENADGSEEETDTRDADFNGTKASE

SEQ ID NO: 54702 - protein, 1945 aa, Homo sapiens
MAQKGQLSDDEKFLFVDKNFINSPVAQADWAAKRLVWVPSEKQGFEAASIKEEKGDEVVVELVENGKKVTVGKDDIQKMNPPKFSKVEDMAELTCLNEASVLHNLRERYFSGLIYTYSGLFCVVVNPYKHLPIYSEKIVDMYKGKKRHEMPPHIYAIADTAYRSMLQDREDQSILCTGESGAGKTENTKKVIQYLAVVASSHKGKKDTSITQGPSFAYGELEKQLLQANPILEAFGNAKTVKNDNSSRFGKFIRINFDVTGYIVGANIETYLLEKSRAIRQARDERTFHIFYYMIAGAKEKMRSDLLLEGFNNYTFLSNGFVPIPAAQDDEMFQETVEAMAIMGFSEEEQLSILKVVSSVLQLGNIVFKKERNTDQASMPDNTAAQKVCHLMGINVTDFTRSILTPRIKVGRDVVQKAQTKEQADFAVEALAKATYERLFRWILTRVNKALDKTHRQGASFLGILDIAGFEIFEVNSFEQLCINYTNEKLQQLFNHTMFILEQEEYQREGIEWNFIDFGLDLQPCIELIERPNNPPGVLALLDEECWFPKATDKSFVEKLCTEQGSHPKFQKPKQLKDKTEFSIIHYAGKVDYNASAWLTKNMDPLNDNVTSLLNASSDKFVADLWKDVDRIVGLDQMAKMTESSLPSASKTKKGMFRTVGQLYKEQLGKLMTTLRNTTPNFVRCIIPNHEKRSGKLDAFLVLEQLRCNGVLEGIRICRQGFPNRIVFQEFRQRYEILAANAIPKGFMDGKQACILMIKALELDPNLYRIGQSKIFFRTGVLAHLEEERDLKITDVIMAFQAMCRGYLARKAFAKRQQQLTAMKVIQRNCAAYLKLRNWQWWRLFTKVKPLLQVTRQEEEMQAKEDELQKTKERQQKAENELKELEQKHSQLTEEKNLLQEQLQAETELYAEAEEMRVRLAAKKQELEEILHEMEARLEEEEDRGQQLQAERKKMAQQMLDLEEQLEEEEAARQKLQLEKVTAEAKIKKLEDEILVMDDQNNKLSKERKLLEERISDLTTNLAEEEEKAKNLTKLKNKHESMISELEVRLKKEEKSRQELEKLKRKLEGDASDFHEQIADLQAQIAELKMQLAKKEEELQAALARLDDEIAQKNNALKKIRELEGHISDLQEDLDSERAARNKAEKQKRDLGEELEALKTELEDTLDSTATQQELRAKREQEVTVLKKALDEETRSHEAQVQEMRQKHAQAVEELTEQLEQFKRAKANLDKNKQTLEKENADLAGELRVLGQAKQEVEHKKKKLEAQVQELQSKCSDGERARAELNDKVHKLQNEVESVTGMLNEAEGKAIKLAKDVASLSSQLQDTQELLQEETRQKLNVSTKLRQLEEERNSLQDQLDEEMEAKQNLERHISTLNIQLSDSKKKLQDFASTVEALEEGKKRFQKEIENLTQQYEEKAAAYDKLEKTKNRLQQELDDLVVDLDNQRQLVSNLEKKQRKFDQLLAEEKNISSKYADERDRAEAEAREKETKALSLARALEEALEAKEELERTNKMLKAEMEDLVSSKDDVGKNVHELEKSKRALETQMEEMKTQLEELEDELQATEDAKLRLEVNMQALKGQFERDLQARDEQNEEKRRQLQRQLHEYETELEDERKQRALAAAAKKKLEGDLKDLELQADSAIKGREEAIKQLRKLQAQMKDFQRELEDARASRDEIFATAKENEKKAKSLEADLMQLQEDLAAAERARKQADLEKEELAEELASSLSGRNALQDEKRRLEARIAQLEEELEEEQGNMEAMSDRVRKATQQAEQLSNELATERSTAQKNESARQQLERQNKELRSKLHEMEGAVKSKFKSTIAALEAKIAQLEEQVEQEAREKQAATKSLKQKDKKLKEILLQVEDERKMAEQYKEQAEKGNARVKQLKRQLEEAEEESQRINANRRKLQRELDEATESNEAMGREVNALKSKLRGPPPQETSQ

SEQ ID NO: 54703 - protein, 1938 aa, Homo sapiens; identical to SEQ ID NO: 54574

SEQ ID NO: 54704 - protein, 666 aa, Homo sapiens [sequence omitted]

SEQ ID NO: 54705 - protein, 2036 aa, Homo sapiens; identical to SEQ ID NO: 54575

SEQ ID NO: 54706 - protein, 1478 aa, Homo sapiens
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKSGSCWKIVWPSSHPRQLRRRRRSRASISYGSNMRPQSQTWRDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATLSPDALTDGAQPPSSLDPTGPCPRNPAL

SEQ ID NO: 54707 - protein, 1779 aa, Homo sapiens
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKSGSCWKIVWPSSHPRQLRRRRRSRASISYGSNMRPQSQTWRDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54708 - protein, 2028 aa, Homo sapiens
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDEHGGFQQFSFLGSFPPSPPGSAERCSSAISPPGVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54709 - protein, 2003 aa, Homo sapiens
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPASVSTVSYGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54710 - protein, 2036 aa, Homo sapiens
MAAVTMSVPGRKAPPRPGPVPEAAQPFLFTPRGPSAGGGPGSGTSPQVEWTARRLVWVPSELHGFEAAALRDEGEEEAEVELAESGRRLRLPRDQIQRMNPPKFSKAEDMAELTCLNEASVLHNLRERYYSGLIYTYSGLFCVVINPYKQLPIYTEAIVEMYRGKKRHEVPPHVYAVTEGAYRSMLQDREDQSILCTGESGAGKTENTKKVIQYLAHVASSPKGRKEPGVPVSNPALGWGELERQLLQANPILEAFGNAKTVKNDNSSRFGKFIRINFDVAGYIVGANIETYLLEKSRAIRQAKDECSFHIFYQLLGGAGEQLKADLLLEPCSHYRFLTNGPSSSPGQERELFQETLESLRVLGFSHEEIISMLRMVSAVLQFGNIALKRERNTDQATMPDNTAAQKLCRLLGLGVTDFSRALLTPRIKVGRDYVQKAQTKEQADFALEALAKATYERLFRWLVLRLNRALDRSPRQGASFLGILDIAGFEIFQLNSFEQLCINYTNEKLQQLFNHTMFVLEQEEYQREGIPWTFLDFGLDLQPCIDLIERPANPPGLLALLDEECWFPKATDKSFVEKVAQEQGGHPKFQRPRHLRDQADFSVLHYAGKVDYKANEWLMKNMDPLNDNVAALLHQSTDRLTAEIWKDEHGGFQQFSFLGSFPPSPPGSAERCSSAISPPGVEGIVGLEQVSSLGDGPPGGRPRRGMFRTVGQLYKESLSRLMATLSNTNPSFVRCIVPNHEKRAGKLEPRLVLDQLRCNGVLEGIRICRQGFPNRILFQEFRQRYEILTPNAIPKGFMDGKQACEKMIQALELDPNLYRVGQSKIFFRAGVLAQLEEERDLKVTDIIVSFQAAARGYLARRAFQKRQQQQSALRVMQRNCAAYLKLRHWQWWRLFTKVKPLLQVTRQDEVLQARAQELQKVQELQQQSAREVGELQGRVAQLEEERARLAEQLRAEAELCAEAEETRGRLAARKQELELVVSELEARVGEEEECSRQMQTEKKRLQQHIQELEAHLEAEEGARQKLQLEKVTTEAKMKKFEEDLLLLEDQNSKLSKERKLLEDRLAEFSSQAAEEEEKVKSLNKLRLKYEATIADMEDRLRKEEKGRQELEKLKRRLDGESSELQEQMVEQQQRAEELRAQLGRKEEELQAALARAEDEGGARAQLLKSLREAQAALAEAQEDLESERVARTKAEKQRRDLGEELEALRGELEDTLDSTNAQQELRSKREQEVTELKKTLEEETRIHEAAVQELRQRHGQALGELAEQLEQARRGKGAWEKTRLALEAEVSELRAELSSLQTARQEGEQRRRRLELQLQEVQGRAGDGERARAEAAEKLQRAQAELENVSGALNEAESKTIRLSKELSSTEAQLHDAQELLQEETRAKLALGSRVRAMEAEAAGLREQLEEEAAARERAGRELQTAQAQLSEWRRRQEEEAGALEAGEEARRRAAREAEALTQRLAEKTETVDRLERGRRRLQQELDDATMDLEQQRQLVSTLEKKQRKFDQLLAEEKAAVLRAVEERERAEAEGREREARALSLTRALEEEQEAREELERQNRALRAELEALLSSKDDVGKSVHELERACRVAEQAANDLRAQVTELEDELTAAEDAKLRLEVTVQALKTQHERDLQGRDEAGEERRRQLAKQLRDAEVERDEERKQRTLAVAARKKLEGELEELKAQMASAGQGKEEAVKQLRKMQAQMKELWREVEETRTSREEIFSQNRESEKRLKGLEAEVLRLQEELAASDRARRQAQQDRDEMADEVANGNLSKAAILEEKRQLEGRLGQLEEELEEEQSNSELLNDRYRKLLLQVESLTTELSAERSFSAKAESGRQQLERQIQELRGRLGEEDAGARARHKMTIAALESKLAQAEEQLEQETRERILSGKLVRRAEKRLKEVVLQVEEERRVADQLRDQLEKGNLRVKQLKRQLEEAEEEASRAQAGRRRLQRELEDVTESAESMNREVTTLRNRLRRGPLTFTTRTVRQVFRLEEGVASDEEAEEAQPGSGPSPEPEGSPPAHPQ

SEQ ID NO: 54711 - protein, 1946 aa, Homo sapiens
MVESCLLTFRAFFWWIALIKMDLSDLGEAAAFLRRSEAELLLLQATALDGKKKCWIPDGENAYIEAEVKGSEDDGTVIVETADGESLSIKEDKIQQMNPPEFEMIEDMAMLTHLNEASVLHTLKRRYGQWMIYTYSGLFCVTINPYKWLPVYQKEVMAAYKGKRRSEAPPHIFAVANNAFQDMLHNRENQSILFTGESGAGKTVNSKHIIQYFATIAAMIESRKKQGALEDQIMQANTILEAFGNAKTLRNDNSSRFGKFIRMHFGARGMLSSVDIDIYLLEKSRVIFQQAGERNYHIFYQILSGQKELHDLLLVSANPSDFHFCSCGAVTVESLDDAEELLATEQAMDILGFLPDEKYGCYKLTGAIMHFGNMKFKQKPREEQLEADGTENADKAAFLMGINSSELVKCLIHPRIKVGNEYVTRGQTIEQVTCAVGALSKSMYERMFKWLVARINRALDAKLSRQFFIGILDITGFEILEYNSLEQLCINFTNEKLQQFFNWHMFVLEQEEYKKESIEWVSIGFGLDLQACIDLIEKPMGILSILEEECMFPKATDLTFKTKLFDNHFGKSVHLQKPKPDKKKFEAHFELVHYAGVVPYNISGWLEKNKDLLNETVVAVFQKSSNRLLASLFENYMSTDSAIPFGEKKRKKGASFQTVASLHKENLNKLMTNLKSTAPHFVRCINPNVNKIPGILDPYLVLQQLRCNGVLEGTRICREGFPNRLQYADFKQRYCILNPRTFPKSKFVSSRKAAEELLGSLEIDHTQYRFGITKVFFKAGFLGQLEAIRDERLSKVFTLFQARAQGKLMRIKFQKILEERDALILIQWNIRAFMAVKNWPWMRLFFKIKPLVKSSEVGEEVAGLKEECAQLQKALEKSEFQREELKAKQVSLTQEKNDLILQLQAEQETLANVEEQCEWLIKSKIQLEARVKELSERVEEEEEINSELTARGRKLEDECFELKKEIDDLETMLVKSEKEKRTTEHKVKNLTEEVEFLNEDISKLNRAAKVVQEAHQQTLDDLHMEEEKLSSLSKANLKLEQQVDELEGALEQERKARMNCERELHKLEGNLKLNRESMENLESSQRHLAEELRKKELELSQMNSKVENEKGLVAQLQKTVKELQTQIKDLKEKLEAERTTRAKMERERADLTQDLADLNERLEEVGGSSLAQLEITKKQETKFQKLHRDMEEATLHFETTSASLKKRHADSLAELEGQVENLQQVKQKLEKDKSDLQLEVDDLLTRVEQMTRAKANAEKLCTLYEERLHEATAKLDKVTQLANDLAAQKTKLWSESGEFLRRLEEKEALINQLSREKSNFTRQIEDLRGQLEKETKSQSALAHALQKAQRDCDLLREQYEEEQEVKAELHRTLSKVNAEMVQWRMKYENNVIQRTEDLEDAKKELAIRLQEAAEAMGVANARNASLERARHQLQLELGDALSDLGKVRSAAARLDQKQLQSGKALADWKQKHEESQALLDASQKEVQALSTELLKLKNTYEESIVGQETLRRENKNLQEEISNLTNQVREGTKNLTEMEKVKKLIEEEKTEVQVTLEETEGALERNESKILHFQLELLEAKAELERKLSEKDEEIENFRRKQQCTIDSLQSSLDSEAKSRIEVTRLKKKMEEDLNEMELQLSCANRQVSEATKSLGQLQIQIKDLQMQLDDSTQLNSDLKEQVAVAERRNSLLQSELEDLRSLQEQTERGRRLSEEELLEATERINLFYTQNTSLLSQKKKLEADVARMQKEAEEVVQECQNAEEKAKKAAIEAANLSEELKKKQDTIAHLERTRENMEQTITDLQKRLAEAEQMALMGSRKQIQKLESRVRELEGELEGEIRRSAEAQRGARRLERCIKELTYQAEEDKKNLSRMQTQMDKLQLKVQNYKQQVEVAETQANQYLSKYKKQQHELNEVKERAEVAESQVNKLKIKAREFGKKVQEE

SEQ ID NO: 54712 - protein, 1941 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLASIDIDHTQYKFGHTKVFFKAGLLGLLEEMRDDKLAQLITRTQARCRGFLARVEYQRMVERREAIFCIQYNIRSFMNVKHWPWMKLFFKIKPLLKSAETEKEMATMKEEFQKIKDELAKSEAKRKELEEKMVTLLKEKNDLQLQVQAEAEGLADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQAEEDKVNTLTKAKIKLEQQVDDLEGSLEQEKKLRMDLERAKRKLEGDLKLAQESIMDIENEKQQLDEKLKKKEFEISNLQSKIEDEQALGIQLQKKIKELQARIEELEEEIEAERASRAKAEKQRSDLSRELEEISERLEEAGGATSAQIEMNKKREAEFQKMRRDLEEATLQHEATAATLRKKHADSVAELGEQIDNLQRVKQKLEKEKSEMKMEIDDLASNVETVSKAKGNLEKMCRTLEDQLSELKSKEEEQQRLINDLTAQRGRLQTESGEFSRQLDEKEALVSQLSRGKQAFTQQIEELKRQLEEEIKAKNALAHALQSSRHDCDLLREQYEEEQESKAELQRALSKANTEVAQWRTKYETDAIQRTEELEEAKKKLAQRLQAAEEHVEAVNAKCASLEKTKQRLQNEVEDLMLDVERTNAACAALDKKQRNFDKILAEWKQKCEETHAELEASQKEARSLGTELFKIKNAYEESLDQLETLKRENKNLQQEISDLTEQIAEGGKRIHELEKIKKQVEQEKCELQAALEEAEASLEHEEGKILRIQLELNQVKSEVDRKIAEKDEEIDQLKRNHIRIVESMQSTLDAEIRSRNDAIRLKKKMEGDLNEMEIQLNHANRMAAEALRNYRNTQGILKDTQIHLDDALRSQEDLKEQLAMVERRANLLQAEIEELRATLEQTERSRKIAEQELLDASERVQLLHTQNTSLINTKKKLETDISQMQGEMEDILQEARNAEEKAKKAITDAAMMAEELKKEQDTSAHLERMKKNMEQTVKDLQLRLDEAEQLALKGGKKQIQKLEARVRELEGEVESEQKRNAEAVKGLRKHERRVKELTYQTEEDRKNILRLQDLVDKLQAKVKSYKRQAEEAEEQSNTNLAKFRKLQHELEEAEERADIAESQVNKLRVKSREVHTKVISEE

SEQ ID NO: 54713 - protein, 1941 aa, Homo sapiens; identical to SEQ ID NO: 54712

SEQ ID NO: 54714 - protein, 182 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESG

SEQ ID NO: 54715 - protein, 134 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPV

SEQ ID NO: 54716 - protein, 708 aa, Homo sapiens
MSSDSELAVFGEAAPFLRKSERERIEAQNRPFDAKTSVFVAEPKESFVKGTIQSREGGKVTVKTEGGATLTVKDDQVFPMNPPKYDKIEDMAMMTHLHEPAVLYNLKERYAAWMIYTYSGLFCVTVNPYKWLPVYKPEVVTAYRGKKRQEAPPHIFSISDNAYQFMLTDRENQSILITGESGAGKTVNTKRVIQYFATIAVTGEKKKEEITSGKIQGTLEDQIISANPLLEAFGNAKTVRNDNSSRFGKFIRIHFGTTGKLASADIETYLLEKSRVVFQLKAERSYHIFYQITSNKKPELIEMLLITTNPYDYPFVSQGEISVASIDDQEELMATDSAIDILGFTNEEKVSIYKLTGAVMHYGNLKFKQKQREEQAEPDGTEVADKAAYLQSLNSADLLKALCYPRVKVGNEYVTKGQTVEQVSNAVGALAKAVYEKMFLWMVARINQQLDTKQPRQYFIGVLDIAGFEIFDFNSLEQLCINFTNEKLQQFFNHHMFVLEQEEYKKEGIEWTFIDFGMDLAACIELIEKPMGIFSILEEECMFPKATDTSFKNKLYDQHLGKSANFQKPKVVKGKAEAHFALIHYAGVVDYNITGWLEKNKDPLNETVVGLYQKSAMKTLAQLFSGAQTAEGEGAGGGAKKGGKKKGSSFQTVSALFREEQSNTNLAKFRKLQHELEEAEERADIAESQVNKLRVKSREVHTKVISEE

SEQ ID NO: 54717 - protein, 1940 aa, Homo sapiens; identical to SEQ ID NO: 54576

SEQ ID NO: 54718 - protein, 1939 aa, Homo sapiens
MSSDSEMAIFGEAAPFLRKSEKERIEAQNKPFDAKTSVFVVDPKESYVKAIVQSREGGKVTAKTEAGATVTVKEDQVFSMNPPKYDKIEDMAMMTHLHEPAVLYNLKERYAAWMIYTYSGLFCVTVNPYKWLPVYNPEVVTAYRGKKRQEAPPHIFSISDNAYQFMLTDRENQSILITGESGAGKTVNTKRVIQYFATIAVTGEKKKEEPASGKMQGTLEDQIISANPLLEAFGNAKTVRNDNSSRFGKFIRIHFGATGKLASADIETYLLEKSRVTFQLKAERSYHIFYQILSNKKPELIEMLLITTNPYDFAFVSQGEITVPSIDDQEELMATDSAVDILGFTADEKVAIYKLTGAVMHYGNMKFKQKQREEQAEPDGTEVADKAAYLTSLNSADLLKSLCYPRVKVGNEFVTKGQTVQQVYNAVGALAKAIYEKMFLWMVTRINQQLDTKQPRQYFIGVLDIAGFEIFDFNSLEQLCINFTNEKLQQFFNHHMFVLEQEEYKKEGIEWEFIDFGMDLAACIELIEKPMGIFSILEEECMFPKATDTSFKNKLYEQHLGKSNNFQKPKPAKGKPEAHFSLVHYAGTVDYNIAGWLDKNKDPLNETVVGLYQKSAMKTLAFLFSGAQTAEAEGGGGKKGGKKKGSSFQTVSALFRENLNKLMTNLRSTHPHFVRCIIPNETKTPGAMEHELVLHQLRCNGVLEGIRICRKGFPSRILYADFKQRYKVLNASAIPEGQFIDSKKASEKLLGSIEIDHTQYKFGHTKVFFKAGLLGTLEEMRDEKLAQLITRTQAICRGFLMRVEFRKMMERRESIFCIQYNIRAFMNVKHWPWMKLYFKIKPLLKSAETEKEMANMKEEFEKTKEELAKTEAKRKELEEKMVTLMQEKNDLQLQVQAEADALADAEERCDQLIKTKIQLEAKIKEVTERAEDEEEINAELTAKKRKLEDECSELKKDIDDLELTLAKVEKEKHATENKVKNLTEEMAGLDETIAKLTKEKKALQEAHQQTLDDLQMEEDKVNTLTKAKTKLEQQVDDLEGSLEQEKKLCMDLERAKRKLEGDLKLAQESTMDTENDKQQLNEKLKKKEFEMSNLQGKIEDEQALAIQLQKKIKELQARIEELEEEIEAERASRAKAEKQRSDLSRELEEISERLEEAGGATSAQIEMNKKREAEFQKMRRDLEESTLQHEATAAALRKKHADSVAELGEQIDSLQRVKQKLEKEKSELKMEINDLASNMETVSKAKANFEKMCRTLEDQLSEIKTKEEEQQRLINELSAQKARLHTESGEFSRQLDEKDAMVSQLSRGKQAFTQQIEELKRQLEEETKAKSTLAHALQSARHDCDLLREQYEEEQEAKAELQRGMSKANSEVAQWRTKYETDAIQRTEELEEAKKKLAQRLQDAEEHVEAVNSKCASLEKTKQRLQNEVEDLMIDVERSNAACIALDKKQRNFDKVLAEWKQKYEETQAELEASQKESRSLSTELFKVKNAYEESLDHLETLKRENKNLQQEISDLTEQIAEGGKHIHELEKVKKQLDHEKSELQTSLEEAEASLEHEEGKILRIQLELNQVKSEIDRKIAEKDEELDQLKRNHLRVVESMQSTLDAEIRSRNDALRIKKKMEGDLNEMEIQLNHANRQAAEALRNLRNTQGILKDTQLHLDDAIRGQDDLKEQLAMVERRANLMQAEVEELRASLERTERGRKMAEQELLDASERVQLLHTQNTSLINTKKKLETDISQIQGEMEDIVQEARNAEEKAKKAITDAAMMAEELKKEQDTSAHLERMKKNMEQTVKDLQLRLDEAEQLALKGGKKQIQKLEARVRELESEVESEQKHNVEAVKGLRKHERRVKELTYQTEEDRKNILRLQDLVDKLQTKVKAYKRQAEEAEEQSNVNLAKFRKLQHELEEAKERADIAESQVNKLRVKSREVHTKVISEE

SEQ ID NO: 54719 - protein, 1939 aa, Homo sapiens
MTDAQMADFGAAAQYLRKSEKERLEAQTRPFDIRTECFVPDDKEEFVKAKILSREGGKVIAETENGKTVTVKEDQVLQQNPPKFDKIEDMAMLTFLHEPAVLFNLKERYAAWMIYTYSGLFCVTVNPYKWLPVYNAEVVAAYRGKKRSEAPPHIFSISDNAYQYMLTDRENQSILITGESGAGKTVNTKRVIQYFASIAAIGDRGKKDNANANKGTLEDQIIQANPALEAFGNAKTVRNDNSSRFGKFIRIHFGATGKLASADIETYLLEKSRVIFQLKAERNYHIFYQILSNKKPELLDMLLVTNNPYDYAFVSQGEVSVASIDDSEELMATDSAFDVLGFTSEEKAGVYKLTGAIMHYGNMKFKQKQREEQAEPDGTEDADKSAYLMGLNSADLLKGLCHPRVKVGNEYVTKGQSVQQVYYSIGALAKAVYEKMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLYDNHLGKSNNFQKPRNIKGKQEAHFSLIHYAGTVDYNILGWLEKNKDPLNETVVALYQKSSLKLMATLFSSYATADTGDSGKSKGGKKKGSSFQTVSALHRENLNKLMTNLRTTHPHFVRCIIPNERKAPGVMDNPLVMHQLRCNGVLEGIRICRKGFPNRILYGDFRQRYRILNPVAIPEGQFIDSRKGTEKLLSSLDIDHNQYKFGHTKVFFKAGLLGLLEEMRDERLSRIITRMQAQARGQLMRIEFKKIVERRDALLVIQWNIRAFMGVKNWPWMKLYFKIKPLLKSAETEKEMATMKEEFGRIKETLEKSEARRKELEEKMVSLLQEKNDLQLQVQAEQDNLNDAEERCDQLIKNKIQLEAKVKEMNERLEDEEEMNAELTAKKRKLEDECSELKKDIDDLELTLAKVEKEKHATENKVKNLTEEMAGLDEIIAKLTKEKKALQEAHQQALDDLQVEEDKVNSLSKSKVKLEQQVDDLEGSLEQEKKVRMDLERAKRKLEGDLKLTQESIMDLENDKLQLEEKLKKKEFDINQQNSKIEDEQVLALQLQKKLKENQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKVSRTLEDQANEYRVKLEEAQRSLNDFTTQRAKLQTENGELARQLEEKEALISQLTRGKLSYTQQMEDLKRQLEEEGKAKNALAHALQSARHDCDLLREQYEEETEAKAELQRVLSKANSEVAQWRTKYETDAIQRTEELEEAKKKLAQRLQDAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGEGGKNVHELEKVRKQLEVEKLELQSALEEAEASLEHEEGKILRAQLEFNQIKAEIERKLAEKDEEMEQAKRNHQRVVDSLQTSLDAETRSRNEVLRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMESDLTQLQSEVEEAVQECRNAEEKAKKAITDAAMMAEELKKEQDTSAHLERMKKNMEQTIKDLQHRLDEAEQIALKGGKKQLQKLEARVRELEGELEAEQKRNAESVKGMRKSERRIKELTYQTEEDKKNLLRLQDLVDKLQLKVKAYKRQAEEAEEQANTNLSKFRKVQHELDEAEERADIAESQVNKLRAKSRDIGAKQKMHDEE

SEQ ID NO: 54720 - protein, 1939 aa, Homo sapiens; identical to SEQ ID NO: 54719

SEQ ID NO: 54721 - protein, 1935 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDVTSNMEQIIKAKANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 54722 - protein, 1940 aa, Homo sapiens
MGDSEMAVFGAAAPYLRKSEKERLEAQTRPFDLKKDVFVPDDKQEFVKAKIVSREGGKVTAETEYGKTVTVKEDQVMQQNPPKFDKIEDMAMLTFLHEPAVLYNLKDRYGSWMIYTYSGLFCVTVNPYKWLPVYTPEVVAAYRGKKRSEAPPHIFSISDNAYQYMLTDRENQSILITGESGAGKTVNTKRVIQYFAVIAAIGDRSKKDQSPGKGTLEDQIIQANPALEAFGNAKTVRNDNSSRFGKFIRIHFGATGKLASADIETYLLEKSRVIFQLKAERDYHIFYQILSNKKPELLDMLLITNNPYDYAFISQGETTVASIDDAEELMATDNAFDVLGFTSEEKNSMYKLTGAIMHFGNMKFKLKQREEQAEPDGTEEADKSAYLMGLNSADLLKGLCHPRVKVGNEYVTKGQNVQQVIYATGALAKAVYERMFNWMVTRINATLETKQPRQYFIGVLDIAGFEIFDFNSFEQLCINFTNEKLQQFFNHHMFVLEQEEYKKEGIEWTFIDFGMDLQACIDLIEKPMGIMSILEEECMFPKATDMTFKAKLFDNHLGKSANFQKPRNIKGKPEAHFSLIHYAGIVDYNIIGWLQKNKDPLNETVVGLYQKSSLKLLSTLFANYAGADAPIEKGKGKAKKGSSFQTVSALHRENLNKLMTNLRSTHPHFVRCIIPNETKSPGVMDNPLVMHQLRCNGVLEGIRICRKGFPNRILYGDFRQRYRILNPAAIPEGQFIDSRKGAEKLLSSLDIDHNQYKFGHTKVFFKAGLLGLLEEMRDERLSRIITRIQAQSRGVLARMEYKKLLERRDSLLVIQWNIRAFMGVKNWPWMKLYFKIKPLLKSAEREKEMASMKEEFTRLKEALEKSEARRKELEEKMVSLLQEKNDLQLQVQAEQDNLADAEERCDQLIKNKIQLEAKVKEMNERLEDEEEMNAELTAKKRKLEDECSELKRDIDDLELTLAKVEKEKHATENKVKNLTEEMAGLDEIIAKLTKEKKALQEAHQQALDDLQAEEDKVNTLTKAKVKLEQQVDDLEGSLEQEKKVRMDLERAKRKLEGDLKLTQESIMDLENDKQQLDERLKKKDFELNALNARIEDEQALGSQLQKKLKELQARIEELEEELEAERTARAKVEKLRSDLSRELEEISERLEEAGGATSVQIEMNKKREAEFQKMRRDLEEATLQHEATAAALRKKHADSVAELGEQIDNLQRVKQKLEKEKSEFKLELDDALLGLPSSNFLLPPPLSANLEKMCRTLEDQMNEHRSKAEETQRSVNDLTSQRAKLQTENGELSRQLDEKEALISQLTRGKLTYTQQLEDLKRQLEEEVKAKNALAHALQSARHDCDLLREQYEEETEAKAELQRVLSKANSEVAQWRTKYETDAIQRTEELEEAKKKLAQRLQEAEEAVEAVNAKCSSLEKTKHRLQNEIEDLMVDVERSNAAAAALDKKQRNFDKILAEWKQKYEESQSELESSQKEARSLSTELFKLKNAYEESLEHLETFKRENKNLQEEISDLTEQLGSSGKTIHELEKVRKQLEAEKMELQSALEEAEASLEHEEGKILRAQLEFNQIKAEIERKLAEKDEEMEQAKRNHLRVVDSLQTSLDAETRSRNEALRVKKKMEGDLNEMEIQLSHANRMAAEAQKQVKSLQSLLKDTQIQLDDAVRANDDLKENIAIVERRNNLLQAELEELRAVVEQTERSRKLAEQELIETSERVQLLHSQNTSLINQKKKMDADLSQLQTEVEEAVQECRNAEEKAKKAITDAAMMAEELKKEQDTSAHLERMKKNMEQTIKDLQHRLDEAEQIALKGGKKQLQKLEARVRELENELEAEQKRNAESVKGMRKSERRIKELTYQTEEDRKNLLRLQDLVDKLQLKVKAYKRQAEEAEEQANTNLSKFRKVQHELDEAEERADIAESQVNKLRAKSRDIGTKGLNEE

SEQ ID NO: 54723 - protein, 1937 aa, Homo sapiens
MSASSDAEMAVFGEAAPYLRKSEKERIEAQNKPFDAKTSVFVAEPKESYVKSTIQSKEGGKVTVKTEGGATLTVREDQVFPMNPPKYDKIEDMAMMTHLHEPGVLYNLKERYAAWMIYTYSGLFCVTVNPYKWLPVYKPEVVAAYRGKKRQEAPPHIFSISDNAYQFMLTDRENQSILITGESGAGKTVNTKRVIQYFATIAVTGEKKKDESGKMQGTLEDQIISANPLLEAFGNAKTVRNDNSSRFGKFIRIHFGTTGKLASADIETYLLEKSRVTFQLKAERSYHIFYQITSNKKPDLIEMLLITTNPYDYAFVSQGEITVPSIDDQEELMATDSAIDILGFTPEEKVSIYKLTGAVMHYGNMKFKQKQREEQAEPDGTEVADKAAYLQSLNSADLLKALCYPRVKVGNEYVTKGQTVQQVYNAVGALAKAVYEKMFLWMVTRINQQLDTKQPRQYFIGVLDIAGFEIFDFNSLEQLCINFTNEKLQQFFNHHMFVLEQEEYKKEGIEWTFIDFGMDLAACIELIEKPLGIFSILEEECMFPKATDTSFKNKLYDQHLGKSANFQKPKVVKGKAEAHFSLIHYAGTVDYNITGWLDKNKDPLNDTVVGLYQKSAMKTLASLFSTYASAEADSSAKKGAKKKGSSFQTVSALFRENLNKLMTNLRSTHPHFVRCIIPNETKTPGAMEHELVLHQLRCNGVLEGIRICRKGFPSRILYGDFKQRYKVLNASAIPEGQFIDSKKASEKLLASIDIDHTQYKFGHTKVFFKAGLLGLLEEMRDEKLAQIITRTQAVCRGFLMRVEYQKMLQRREALFCIQYNVRAFMNVKHWPWMKLFFKIKPLLKSAETEKEMATMKEEFQKTKDELAKSEAKRKELEEKMVTLLKEKNDLQLQVQSEADSLADAEERCEQLIKNKIQLEAKIKEVTERAEEEEEINAELTAKKRKLEDECSELKKDIDDLELTLAKVEKEKHATENKVKNLTEEMAGLDETIAKLSKEKKALQETHQQTLDDLQAEEDKVNILTKAKTKLEQQVDDLEGSLEQEKKLRMDLERAKRKLEGDLKLAQESTMDMENDKQQLDEKLEKKEFEISNLISKIEDEQAVEIQLQKKIKELQARIEELGEEIEAERASRAKAEKQRSDLSRELEEISERLEEAGGATSAQVELNKKREAEFQKLRRDLEEATLQHEAMVAALRKKHADSMAELGEQIDNLQRVKQKLEKEKSELKMETDDLSSNAEAISKAKGNLEKMCRSLEDQVSELKTKEEEQQRLINDLTAQRARLQTEAGEYSRQLDEKDALVSQLSRSKQASTQQIEELKHQLEEETKAKNALAHALQSSRHDCDLLREQYEEEQEGKAELQRALSKANSEVAQWRTKYETDAIQRTEELEEAKKKLAQRLQEAEEHVEAVNAKCASLEKTKQRLQNEVEDLMLDVERSNAACAALDKKQRNFDKVLSEWKQKYEETQAELEASQKESRSLSTELFKVKNVYEESLDQLETLRRENKNLQQEISDLTEQIAEGGKQIHELEKIKKQVEQEKCEIQAALEEAEASLEHEEGKILRIQLELNQVKSEVDRKIAEKDEEIDQLKRNHTRVVETMQSTLDAEIRSRNDALRVKKKMEGDLNEMEIQLNHANRLAAESLRNYRNTQGILKETQLHLDDALRGQEDLKEQLAIVERRANLLQAEIEELWATLEQTERSRKIAEQELLDASERVQLLHTQNTSLINTKKKLENDVSQLQSEVEEVIQESRNAEEKAKKAITDAAMMAEELKKEQDTSAHLERMKKNLEQTVKDLQHRLDEAEQLALKGGKKQIQKLEARVRELEGEVENEQKRNAEAVKGLRKHERRVKELTYQTEEDRKNVLRLQDLVDKLQAKVKSYKRQAEEAEEQSNANLSKFRKLQHELEEAEERADIAESQVNKLRVKSREVHTKISAE

SEQ ID NO: 54724 - protein, 1937 aa, Homo sapiens; identical to SEQ ID NO: 54723

SEQ ID NO: 54725 - protein, 150 aa, Homo sapiens
MSFSADQIAEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 54726 - protein, 194 aa, Homo sapiens
MAPKKDVKKPVAAAAAAPAPAPAPAPAPAPAKPKEEKIDLSAIKIEFSKEQQDEFKEAFLLFDRTGDSKITLSQVGDVLRALGTNPTNAEVRKVLGNPSNEELNAKKIEFEQFLPMMQAISNNKDQATYEDFVEGLRVFDKEGNGTVMGAELRHVLATLGEKMKEEEVEALMAGQEDSNGCINYEAFVKHIMSI

SEQ ID NO: 54727 - protein, 172 aa, Homo sapiens; identical to SEQ ID NO: 54619

SEQ ID NO: 54728 - protein, 172 aa, Homo sapiens; identical to SEQ ID NO: 54619

SEQ ID NO: 54729 - protein, 172 aa, Homo sapiens; identical to SEQ ID NO: 54619

SEQ ID NO: 54730 - protein, 172 aa, Homo sapiens; identical to SEQ ID NO: 54619

SEQ ID NO: 54731 - protein, 166 aa, Homo sapiens
MAPKKAKKRAGGANSNVFSMFEQTQIQEFKEAFTIMDQNRDGFIDKNDLRDTFAALGRVNVKNEEIDEMIKEAPGPINFTVFLTMFGEKLKGADPEETILNAFKVFDPEGKGVLKADYVREMLTTQAERFSKEEVDQMFAAFPPDVTGNLDYKNLVHIITHGEEKD

SEQ ID NO: 54732 - protein, 195 aa, Homo sapiens
MAPKKPEPKKDDAKAAPKAAPAPAPPPEPERPKEVEFDASKIKIEFTPEQIEEFKEAFMLFDRTPKCEMKITYGQCGDVLRALGQNPTQAEVLRVLGKPRQEELNTKMMDFETFLPMLQHISKNKDTGTYEDFVEGLRVFDKEGNGTVMGAELRHVLATLGERLTEDEVEKLMAGQEDSNGCINYEAFVKHIMSS

SEQ ID NO: 54733 - protein, 195 aa, Homo sapiens; identical to SEQ ID NO: 54732

SEQ ID NO: 54734 - protein, 46 aa, Homo sapiens
MAPKKPEPKKDDAKAAPKAAPAPAPPPEPERPKEVEFDASKIKIEF

SEQ ID NO: 54735 - protein, 197 aa, Homo sapiens
MAPKKPEPKKEAAKPAPAPAPAPAPAPAPAPEAPKEPAFDPKSVKIDFTADQIEEFKEAFSLFDRTPTGEMKITYGQCGDVLRALGQNPTNAEVLRVLGKPKPEEMNVKMLDFETFLPILQHISRNKEQGTYEDFVEGLRVFDKESNGTVMGAELRHVLATLGEKMTEAEVEQLLAGQEDANGCINYEAFVKHIMSG

SEQ ID NO: 54736 - protein, 197 aa, Homo sapiens; identical to SEQ ID NO: 54735

SEQ ID NO: 54737 - protein, 87 aa, Homo sapiens
PEAPKEPAFDPKSVKVIGCPCPRSQSHGAVIDFTADQIEEFKEAFMGAELRHVLATLVIKSAPPPKPTAGEKMTEAEVEQLLAGQED

SEQ ID NO: 54738 - protein, 173 aa, Homo sapiens
MASRKTKKKEGGALRAQRASSNVFSNFEQTQIQEFKEAFTLMDQNRDGFIDKEDLKDTYASLGKTNVKDDELDAMLKEASGPINFTMFLNLFGEKLSGTDAEETILNAFKMLDPDGKGKINKEYIKRLLMSQADKMTAEEVDQMFQFASIDVAGNLDYKALSYVITHGEEKEE

SEQ ID NO: 54739 - protein, 132 aa, Homo sapiens
MDQNRDGFIDKEDLKDTYASLGKTNVKDDELDAMLKEASGPINFTMFLNLFGEKLSGTDAEETILNAFKMLDPDGKGKINKEYIKRLLMSQADKMTAEEVDQMFQFASIDVAGNLDYKALSYVITHGEEKEE

SEQ ID NO: 54740 - protein, 132 aa, Homo sapiens; identical to SEQ ID NO: 54739

SEQ ID NO: 54741 - protein, 132 aa, Homo sapiens; identical to SEQ ID NO: 54739

SEQ ID NO: 54742 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEELVRMVLNG

SEQ ID NO: 54743 - protein, 151 aa, Homo sapiens
MCDFTEDQTAEFKEAFQLFDRTGDGKILYSQCGDVMRALGQNPTNAEVLKVLGNPKSDEMNVKVLDFEHFLPMLQTVAKNKDQGTYEDYVEGLRVFDKEGNGTVMGAEIRHVLVTLGEKMTEEEVEMLVAGHEDSNGCINYEAFVRHILSG

SEQ ID NO: 54744 - protein, 151 aa, Homo sapiens; identical to SEQ ID NO: 54743

SEQ ID NO: 54745 - protein, 208 aa, Homo sapiens
MPPKKDVPVKKPAGPSISKPAAKPAAAGAPPAKTKAEPAVPQAPQKTQEPPVDLSKVVIEFNKDQLEEFKEAFELFDRVGDGKILYSQCGDVMRALGQNPTNAEVLKVLGNPKSDELKSRRVDFETFLPMLQAVAKNRGQGTYEDYLEGFRVFDKEGNGKVMGAELRHVLTTLGEKMTEEEVETVLAGHEDSNGCINYEAFLKHILSV

SEQ ID NO: 54746 - protein, 208 aa, Homo sapiens; identical to SEQ ID NO: 54745

SEQ ID NO: 54747 - protein, 29 aa, Homo sapiens
MPPKKDVPVKKPAGPSISKPAAKPAAAGA

SEQ ID NO: 54748 - protein, 208 aa, Homo sapiens; identical to SEQ ID NO: 54745

SEQ ID NO: 54749 - protein, 175 aa, Homo sapiens
MASRKAGTRGKVAATKQAQRGSSNVFSMFEQAQIQEFKEAFSCIDQNRDGIICKADLRETYSQLGKVSVPEEELDAMLQEGKGPINFTVFLTLFGEKLNGTDPEEAILSAFRMFDPSGKGVVNKDEFKQLLLTQADKFSPAEVEQMFALTPMDLAGNIDYKSLCYIITHGDEKEE

SEQ ID NO: 54750 - protein, 148 aa, Homo sapiens
MFEQAQIQEFKEAFSCIDQNRDGIICKADLRETYSQLGKVSVPEEELDAMLQEGKGPINFTVFLTLFGEKLNGTDPEEAILSAFRMFDPSGKGVVNKDEFKQLLLTQADKFSPAEVEQMFALTPMDLAGNIDYKSLCYIITHGDEKEE

SEQ ID NO: 54751 - protein, 375 aa, Homo sapiens
MQKLQLCVYIYLFMLIVAGPVDLNENSEQKENVEKEGLCNACTWRQNTKSSRIEAIKIQILSKLRLETAPNISKDVIRQLLPKAPPLRELIDQYDVQRDDSSDGSLEDDDYHATTETIITMPTESDFLMQVDGKPKCCFFKFSSKIQYNKVVKAQLWIYLRPVETPTTVFVQILRLIKPMKDGTRYTGIRSLKLDMNPGTGIWQSIDVKTVLQNWLKQPESNLGIEIKALDENGHDLAVTFPGPGEDGLNPFLEVKVTDTPKRSRRDFGLDCDEHSTESRCCRYPLTVDFEAFGWDWIIAPKRYKANYCSGECEFVFLQKYPHTHLVHQANPRGSAGPCCTPTKMSPINMLYFNGKEQIIYGKIPAMVVDRCGCS

SEQ ID NO: 54752 - protein, 498 aa, Homo sapiens
MFNYERPKHFIQSQNPCGSRLQPPGPETSSFSSQTKQSSIIIQPRQCTEQRFSASSTLSSHITMSSSAFPASPKQHAGSNPGQRVTTTYNQSPASFLSSILPSQPDYNSSKIPSAMDSNYQQSSAGQPINAKPSQTANAKPIPRTPDHEIQGSKEALIQDLERKLKCKDTLLHNGNQRLTYEEKMARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 54753 - protein, 314 aa, Homo sapiens
MARRLLGPQNAAAVFQAQDDSGAQDSQQHNSEHARLQVPTSQVRSRSTSRGDVNDQDAIQEKFYPPRFIQVPENMSIDEGRFCRMDFKVSGLPAPDVSWYLNGRTVQSDDLHKMIVSEKGLHSLIFEVVRASDAGAYACVAKNRAGEATFTVQLDVLAKEHKRAPMFIYKPQSKKVLEGDSVKLECQISAIPPPKLFWKRNNEMVQFNTDRISLYQDNTGRVTLLIKDVNKKDAGWYTVSAVNEAGVTTCNTRLDVTARPNQTLPAPKQLRVRPTFSKYLALNGKGLNVKQAFNPEGEFQRLAAQSGLYESEEL

SEQ ID NO: 54754 - protein, 118 aa, Homo sapiens
MCDKEFMWALKNGDLDEVKDYVAKGEDVNRTLEGGRKPLHYAADCGQLEILEFLLLKGADINAPDKHHITPLLSAVYEGHVSCVKLLLSKGADKTVKGPDGLTAFEATDNQAIKALLQ

SEQ ID NO: 54755 - protein, 603 aa, Homo sapiens
MASASTSKYNSHSLENESIKRTSRDGVNRDLTEAVPRLPGETLITDKEVIYICPFNGPIKGRVYITNYRLYLRSLETDSSLILDVPLGVISRIEKMGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 54756 - protein, 566 aa, Homo sapiens
MASASTSKYNSHSLENESIKRTSRDGVNRDLTEAVPRLPGETLITDKEVIYICPFNGPIKGRVYITNYRLYLRSLETDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 54757 - protein, 416 aa, Homo sapiens
MGGATSRGENSYGLDITCKDMRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQALHFLSLSLCRRLQKGLFLYGH

SEQ ID NO: 54758 - protein, 488 aa, Homo sapiens
MRNLRFALKQEGHSRRDMFEILTRYAFPLAHSLPLFAFLNEEKFNVDGWTVYNPVEEYRRQGLPNHHWRITFINKCYELCDTYPALLVVPYRASDDDLRRVATFRSRNRIPVLSWIHPENKTVIVRCSQPLVGMSGKRNKDDEKYLDVIRETNKQISKLTIYDARPSVNAVANKATGGGYESDDAYHNAELFFLDIHNIHVMRESLKKVKDIVYPNVEESHWLSSLESTHWLEHIKLVLTGAIQVADKVSSGKSSVLVHCSDGWDRTAQLTSLAMLMLDSFYRSIEGFEILVQKEWISFGHKFASRIGHGDKNHTDADRSPIFLQFIDCVWQMSKQFPTAFEFNEQFLIIILDHLYSCRFGTFLFNCESARERQKVTERTVSLWSLINSNKEKFKNPFYTKEINRVLYPVASMRHLELWVNYYIRWNPRIKQQQPNPVEQRYMELLALRDEYIKRLEELQLANSAKLSDPPTSPSSPSQMMPHVQTHF

SEQ ID NO: 54759 - protein, 665 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 54760 - protein, 87 aa, Homo sapiens
MEEAPLFPGESIKAIVKDVMYICPFMGAVSGTLTVTDFKLYFKNVERDPHFILDVPLGVISRVEKIGAQSHGDNSCGIEIVCKDMRN

SEQ ID NO: 54761 - protein, 87 aa, Homo sapiens; identical to SEQ ID NO: 54760

SEQ ID NO: 54762 - protein, 90 aa, Homo sapiens
MEEAPLFPGESIKAIVKDVMYICPFMGAVSGTLTVTDFKLYFKNVERDPHFILDVPLGVISRVEKIGAQSHGDNSCGIEIVCKDMRNLRL

SEQ ID NO: 54763 - protein, 673 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKVFRRPDLRALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 54764 - protein, 568 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEAWGAGTQRARGSLRSR

SEQ ID NO: 54765 - protein, 147 aa, Homo sapiens
MEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGL

SEQ ID NO: 54766 - protein, 393 aa, Homo sapiens
MYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEAWGAGTQRARGSLRSR

SEQ ID NO: 54767 - protein, 571 aa, Homo sapiens
MEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKTKGGGYESESAYPNAELVFLEIHNIHVMRESLRKLKEIVYPSIDEARWLSNVDGTHWLEYIRMLLAGAVRIADKIESGKTSVVVHCSDGWDRTAQLTSLAMLMLDSYYRTIKGFETLVEKEWISFGHRFALRVGHGNDNHADADRSPIFLQFVDCVWQMTRQFPSAFEFNELFLITILDHLYSCLFGTFLCNCEQQRFKEDVYTKTISLWSYINSQLDEFSNPFFVNYENHVLYPVASLSHLELWVNYYVRWNPRMRPQMPIHQNLKELLAVRAELQKRVEGLQREVATRAVSSSSERGSSPSHSATSVHTSV

SEQ ID NO: 54768 - protein, 363 aa, Homo sapiens
MDRPAAAAAAGCEGGGGPNPGPAGGRRPPRAAGGATAGSRQPSVETLDSPTGSHVEWCKQLIAATISSQISGSVTSENVSRDYKALRDGNKLAQMEEAPLFPGESIKAIVKDVMYICPFMGAVSGTLTVTDFKLYFKNVERDPHFILDVPLGVISRVEKIGAQSHGDNSCGIEIVCKDMRNLRLAYKQEEQSKLGIFENLNKHAFPLSNGQALFAFSYKEKFPINGWKVYDPVSEYKRQGLPNESWKISKINSNYEFCDTYPAIIVVPTSVKDDDLSKVAAFRAKGRVPVLSWIHPESQATITRCSQPLVGPNDKRCKEDEKYLQTIMDANAQSHKLIIFDARQNSVADTNKLWYQDTASLME

SEQ ID NO: 54769 - protein, 665 aa, Homo sapiens; identical to SEQ ID NO: 54759

SEQ ID NO: 54770 - protein, 637 aa, Homo sapiens
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 54771 - protein, 693 aa, Homo sapiens
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEVPVFLLFLDCVWQLVHQHPPAFEFTETYLTVLSDSLYIPIFSTFFFNSPHQKDTNMHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 54772 - protein, 747 aa, Homo sapiens
MLGKGVVGGGGGTKAPKPSFVSYVRPEEIHTNEKEVTEKEVTLHLLPGEQLLCEASTVLKYVQEDSCQHGVYGRLVCTDFKIAFLGDDESALDNDETQFKNKVIGENDITLHCVDQIYGVFDEKKKTLFGQLKKYPEKLIIHCKDLRVFQFCLRYTKEEEVKRIVSGIIHHTQAPKLLKRLFLFSYATAAQNNTVTDPKNHTVMFDTLKDWCWELERTKGNMKYKAVSVNEGYKVCERLPAYFVVPTPLPEENVQRFQGHGIPIWCWSCHNGSALLKMSALPKEQDDGILQIQKSFLDGIYKTIHRPPYEIVKTEDLSSNFLSLQEIQTAYSKFKQLFLIDNSTEFWDTDIKWFSLLESSSWLDIIRRCLKKAIEITECMEAQNMNVLLLEENASDLCCLISSLVQLMMDPHCRTRIGFQSLIQKEWVMGGHCFLDRCNHLRQNDKEEVPVFLLFLDCVWQLVHQHPPAFEFTETYLTVLSDSLYIPIFSTFFFNSPHQKDTNMGREGQDTQSKPLNLLTVWDWSVQFEPKAQTLLKNPLYVEKPKLDKGQRKGMRFKHQRQLSLPLTQSKSSPKRGFFREETDHLIKNLLGKRISKLINSSDELQDNFREFYDSWHSKSTDYHGLLLPHIEGPEIKVWAQRYLRWIPEAQILGGGQVATLSKLLEMMEEVQSLQEKIDERHHSQQAPQAEAPCLLRNSARLSSLFPFALLQRHSSKPVLPTSGWKALGDEDDLAKREDEFVDLGDV

SEQ ID NO: 54773 - protein, 650 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRSVDHPLPGSSLSTDYGSWQMVTGCGSIQERAVLHTDSSLPFSFPDELPNSCLLAALSDRETRLQEVRSAFLAAYSSTVGLRAVAPSPSGAIGGLLEQFARGVGLRSISSNAL

SEQ ID NO: 54774 - protein, 538 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWLAALSDRETRLQEVRSAFLAAYSSTVGLRAVAPSPSGAIGGLLEQFARGVGLRSISSNAL

SEQ ID NO: 54775 - protein, 598 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYEAVELVPAGAPTQAAWRKSHSSSPQSVLWNRPQPSEDRLPSQQGLAEARSSSSSSSNHSDNFFRMGSSPLEVPKPRLAALSDRETRLQEVRSAFLAAYSSTVGLRAVAPSPSGAIGGLLEQFARGVGLRSISSNAL

SEQ ID NO: 54776 - protein, 520 aa, Homo sapiens
MAGARAAAAAASAGSSASSGNQPPQELGLGELLEEFSRTQYRAKDGSGTGGSKVERIEKRCLELFGRDYCFSVIPNTNGDICGHYPRHIVFLEYESSEKEKDTFESTVQVSKLQDLIHRSKMARCRGRFVCPVILFKGKHICRSATLAGWGELYGRSGYNYFFSGGADDAWADVEDVTEEDCALRSGDTHLFDKVRGYDIKLLRYLSVKYICDLMVENKKVKFGMNVTSSEKVDKAQRYADFTLLSIPYPGCEFFKEYKDRDYMAEGLIFNWKQDYVDAPLSIPDFLTHSLNIDWSQYQCWDLVQQTQNYLKLLLSLVNSDDDSGLLVHCISGWDRTPLFISLLRLSLWADGLIHTSLKPTEILYLTVAYDWFLFGHMLVDRLSKGEEIFFFCFNFLKHITSEEFSALKTQRRKSLPARDGGFTLEDICMLRRKDRGSTTSLGSDFSLVMESSPGATGSFTYERGAGPSRSANSGSLEEEPLILSTECPLEPATTLRGPLAFPAGAGGSQVFQLLFLKPF

SEQ ID NO: 54777 - protein, 643 aa, Homo sapiens
MEKSSSCESLGSQPAAARPPSVDSLSSASTSHSENSVHTKSASVVSSDSISTSADNFSPDLRVLRESNKLAEMEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 54778 - protein, 571 aa, Homo sapiens
MEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAYQNAELVFLDIHNIHVMRESLRKLKEIVYPNIEETHWLSNLESTHWLEHIKLILAGALRIADKVESGKTSVVVHCSDGWDRTAQLTSLAMLMLDGYYRTIRGFEVLVEKEWLSFGHRFQLRVGHGDKNHADADRSPVFLQFIDCVWQMTRQFPTAFEFNEYFLITILDHLYSCLFGTFLCNSEQQRGKENLPKRTVSLWSYINSQLEDFTNPLYGSYSNHVLYPVASMRHLELWVGYYIRWNPRMKPQEPIHNRYKELLAKRAELQKKVEELQREISNRSTSSSERASSPAQCVTPVQTVV

SEQ ID NO: 54779 - protein, 571 aa, Homo sapiens; identical to SEQ ID NO: 54778

SEQ ID NO: 54780 - protein, 571 aa, Homo sapiens; identical to SEQ ID NO: 54778

SEQ ID NO: 54781 - protein, 326 aa, Homo sapiens
MLAVALTILSASTSHSENSVHTKSASVVSSDSISTSADNFSPDLRVLRESNKLAEMEEPPLLPGENIKDMAKDVTYICPFTGAVRGTLTVTNYRLYFKSMERDPPFVLDASLGVINRVEKIGGASSRGENSYGLETVCKDIRNLRFAHKPEGRTRRSIFENLMKYAFPVSNNLPLFAFEYKEVFPENGWKLYDPLLEYRRQGIPNESWRITKINERYELCDTYPALLVVPANIPDEELKRVASFRSRGRIPVLSWIHPESQATITRCSQPMVGVSGKRSKEDEKYLQAIMDSNAQSHKIFIFDARPSVNAVANKAKGGGYESEDAY

SEQ ID NO: 54782 - protein, 1170 aa, Homo sapiens
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVMTRWLPDHLAAHCYACDSAFWLASRKHHCRDTDRVDQTWNCGNVFCSSCCNQKVPVPSQQLFEPSRVCKSCYSSLHPTSSSIDLELDKPIAATSN

SEQ ID NO: 54783 - protein, 1161 aa, Homo sapiens
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 54784 - protein, 1198 aa, Homo sapiens
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEVYASEKEQHGDLCRPGEHVTSRFKNEVERMGFDMNNAWRISNINEKYKLCGSYPQELIVPAWITDKELESVSSFRSWKRIPAVIYRHQSNGAVIARCGQPEVSWWGWRNADDEHLVQSVAKACASDSRSSGSKLSTRNTSRDFPNGGDLSDVEFDSSLSNASGAESLAIQPQKLLILDARSYAAAVANRAKGGGCECPEYYPNCEVVFMGMANIHSIRRSFQSLRLLCTQMPDPGNWLSALESTKWLHHLSVLLKSALLVVHAVDQDQRPVLVHCSDGWDRTPQIVALAKLLLDPYYRTIEGFQVLVEMEWLDFGHKFADRCGHGENSDDLNERCPVFLQWLDCVHQLQRQFPCSFEFNEAFLVKLVQHTYSCLFGTFLCNNAKERGEKHTQERTCSVWSLLRAGNKAFKNLLYSSQSEAVLYPVCHVRNLMLWSAVYLPCPSPTTPVDDSCAPYPAPGTSPDDPPLSRLPKTRSYDNLTTACDNTVPLASRRCSDPSLNEKWQEHRRSLELSSLAGPGEDPLSADSLGKPTRVPGGAELSVAAGVAEGQMENILQEATKEESGVEEPAHRAGIEIQEGKEDPLLEKESRRKTPEASAIGLHQDPELGDAALRSHLDMSWPLFSQGISEQQSGLSVLLSSLQVPPRGEDSLEVPVEQFRIEEIAEGREEAVLPIPVDAKVGYGTSQSCSLLPSQVPFETRGPNVDSSTDMLVEDKVKSVSGPQGHHRSCLVNSGKDRLPQTMEPSPSETSLVERPQVGSVVHRTSLGSTLSLTRSPCALPLAECKEGLVCNGAPETENRASEQPPGLSTLQMYPTPNGHCANGEAGRSKDSLSRQLSAMSCSSAHLHSRNLHHKWLHSHSGRPSATSSPDQPSRSHLDDDGMSVYTDTIQQRLRQIESGHQQEVETLKKQVQELKSRLESQYLTSSLHFNGDFGDEVTSIPDSESNLDQNCLSRCSTEIFSEASWEQVDKQDTEMTRWLPDHLAAHCYACDSAFWLASRKHHCRNCGNVFCSSCCNQKVPVPSQQLFEPSRVCKSCYSSLHPTSSSIDLELDKPIAATSN

SEQ ID NO: 54785 - protein, 1170 aa, Homo sapiens; identical to SEQ ID NO: 54782

SEQ ID NO: 54786 - protein, 139 aa, Homo sapiens
MDEETRHSLECIQANQIFPRKQLIREDENLQVPFLELHGESTEFVGRAEDAIIALSNYRLHIKFKESLVNVPLQLIESVECRDIFQLHLTCKDCKVIRCQFSTFEQCQEWLKRLNNAIRPPAKIEDLFSFAYHAWCMEV

SEQ ID NO: 54787 - protein, 1195 aa, Homo sapiens
MGEEGPPSLEYIQAKDLFPPKELVKEEENLQVPFTVLQGEGVEFLGRAADALIAISNYRLHIKFKDSVINVPLRMIDSVESRDMFQLHISCKDSKVVRCHFSTFKQCQEWLSRLSRATARPAKPEDLFAFAYHAWCLGLTEEDQHTHLCQPGEHIRCRQEAELARMGFDLQNVWRVSHINSNYKLCPSYPQKLLVPVWITDKELENVASFRSWKRIPVVVYRHLRNGAAIARCSQPEISWWGWRNADDEYLVTSIAKACALDPGTRATGGSLSTGNNDTSEACDADFDSSLTACSGVESTAAPQKLLILDARSYTAAVANRAKGGGCECEEYYPNCEVVFMGMANIHAIRNSFQYLRAVCSQMPDPSNWLSALESTKWLQHLSVMLKAAVLVANTVDREGRPVLVHCSDGWDRTPQIVALAKILLDPYYRTLEGFQVLVESDWLDFGHKFGDRCGHQENVEDQNEQCPVFLQWLDSVHQLLKQFPCLFEFNEAFLVKLVQHTYSCLYGTFLANNPCEREKRNIYKRTCSVWALLRAGNKNFHNFLYTPSSDMVLHPVCHVRALHLWTAVYLPASSPCTLGEENMDLYLSPVAQSQEFSGRSLDRLPKTRSMDDLLSACDTSSPLTRTSSDPNLNNHCQEVRVGLEPWHSNPEGSETSFVDSGVGGPQQTVGEVGLPPPLPSSQKDYLSNKPFKSHKSCSPSYKLLNTAVPREMKSNTSDPEIKVLEETKGPAPDPSAQDELGRTLDGIGEPPEHCPETEAVSALSKVISNKCDGVCNFPESSQNSPTGTPQQAQPDSMLGVPSKCVLDHSLSTVCNPPSAACQTPLDPSTDFLNQDPSGSVASISHQEQLSSVPDLTHGEEDIGKRGNNRNGQLLENPRFGKMPLELVRKPISQSQISEFSFLGSNWDSFQGMVTSFPSGEATPRRLLSYGCCSKRPNSKQMRATGPCFGGQWAQREGVKSPVCSSHSNGHCTGPGGKNQMWLSSHPKQVSSTKPVPLNCPSPVPPLYLDDDGLPFPTDVIQHRLRQIEAGYKQEVEQLRRQVRELQMRLDIRHCCAPPAEPPMDYEDDFTCLKESDGSDTEDFGSDHSEDCLSEASWEPVDKKETEVTRWVPDHMASHCYNCDCEFWLAKRRHHCRNCGNVFCAGCCHLKLPIPDQQLYDPVLVCNSCYEHIQVSRARELMSQQLKKPIATASS

SEQ ID NO: 54788 - protein, 189 aa, Homo sapiens
MPVWKLPWKLSEGKRRAQVEGEDLFPVAISFGRPKEVLPLYSSESHRFTVLEPNTVSFNFKFWRNMYHQFDRTLHPRQSVFNIIMNMNEQNKQLEKDIKDLESKIKQRKNKQTDGILTKELLHSVHPESPNLKTSLCFKEQTLLPVNDALRTIEGSSPADNRYSEYAEEFSKSEPAVVSLEYGVARMTC

SEQ ID NO: 54789 - protein, 621 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEAAICRCSQPLSGFSARCLEDEHLLQAISKANPVNRYMYVMDTRPKLNAMANRAAGKGYENEDNYSNIRFQFVGIENIHVMRSSLQKLLEVNGTKGLSVNDFYSGLESSGWLRHIKAVMDAAIFLAKAITVENASVLVHCSDGWDRTSQVCSLGSLLLDSYYRTIKGFMVLIEKDWISFGHKFSERCGQLDGDPKEVSPVFTQFLECVWHLTEQFPQAFEFSEAFLLQIHEHIHSCQFGNFLGNCQKEREELKLKEKTYSLWPFLLEDQKKYLNPLYSSESHRFTVLEPNTVSFNFKFWRNMYHQFDRTLHPRQSVFNIIMNMNEQNKQLEKDIKDLESKIKQRKNKQTDGILTKELLHSVHPESPNLKTSLCFKEQTLLPVNDALRTIEGSSPADNRYSEYAEEFSKSEPAVVSLEYGVARMTC

SEQ ID NO: 54790 - protein, 548 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEAAICRCSQPLSGFSARCLEDEHLLQAISKANPVNRYMYVMDTRPKLNAMANRAAGKGYENEDNYSNIRFQFVGIENIHVMRSSLQKLLEVNGTKGLSVNDFYSGLESSGWLRHIKAVMDAAIFLAKAITVENASVLVHCSDGWDRTSQVCSLGSLLLDSYYRTIKGFMVLIEKDWISFGHKFSERCGQLDGDPKEVSPVFTQFLECVWHLTEQFPQAFEFSEAFLLQIHEHIHSCQFGNFLGNCQKEREELKLKEKTYSLWPFLLEDQKKYLNPLYSSESHRFTVLEPNTVSFNFKFWRNMYHQFDRTLHPRQSVFNIIMNMNEQNKQLEKDIKDLESLTSYSSFKIIVGQ

SEQ ID NO: 54791 - protein, 548 aa, Homo sapiens
MEHIRTTKVEQVKLLDRFSTSNKSLTGTLYLTATHLLFIDSHQKETWILHHHIASVEKLALTTSGCPLVIQCKNFRTVHFIVPRERDCHDIYNSLLQLSKQAKYEDLYAFSYNPKQNDSERLQGWQLIDLAEEYKRMGVPNSHWQLSDANRDYKICETYPRELYVPRIASKPIIVGSSKFRSKGRFPVLSYYHQDKEAAICRCSQPLSGFSARCLEDEHLLQAISKANPVNRYMYVMDTRPKLNAMANRAAGKGYENEDNYSNIRFQFVGIENIHVMRSSLQKLLEVNGTKGLSVNDFYSGLESSGWLRHIKAVMDAAIFLAKAITVENASVLVHCSDGWDRTSQVCSLGSLLLDSYYRTIKGFMVLIEKDWISFGHKFSERCGQLDGDPKEVSPVFTQFLECVWHLTEQFPQAFEFSEAFLLQIHEHIHSCQFGNFLGNCQKEREELKLKEKTYSLWPFLLEDQKKYLNPLYSSESHRFTVLEPNTVSFNFKFWRNMYHQFDRTLHPRQSVFNIIMNMNEQNKQLEKDIKDLESFTSFAAARVIQGQ

SEQ ID NO: 54792 - protein, 660 aa, Homo sapiens
MEHIRTPKVENVRLVDRVSPKKAALGTLYLTATHVIFVENSPDPRKETWILHSQISTIEKQATTATGCPLLIRCKNFQIIQLIIPQERDCHDVYISLIRLARPVKYEELYCFSFNPMLDKEEREQGWVLIDLSEEYTRMGLPNHYWQLSDVNRDYRVCDSYPTELYVPKSATAHIIVGSSKFRSRRRFPVLSYYYKDNHASICRSSQPLSGFSARCLEDEQMLQAIRKANPGSDFVYVVDTRPKLNAMANRAAGKGYENEDNYSNIKFQFIGIENIHVMRNSLQKMLEVCELKSPSMSDFLWGLENSGWLRHIKAIMDAGIFIAKAVSEEGASVLVHCSDGWDRTAQVCSVASLLLDPHYRTLKGFMVLIEKDWISFGHKFNHRYGNLDGDPKEISPVIDQFIECVWQLMEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEERLEKIQKVQLNCTKVKSKQSEPSKHSGFSTSDNSIANTPQDYSGNMKSFPSRSPSQGDEDSALILTQDNLKSSDPDLSANSDQESGVEDLSCRSPSGGEHAPSEDSGKDRDSDEAVFLTA

SEQ ID NO: 54793 - protein, 251 aa, Homo sapiens
MEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEERLEKIQKVQLNCTKVKSKQSEPSKHSGFSTSDNSIANTPQDYSGNMKSFPSRSPSQGDEDSALILTQDNLKSSDPDLSANSDQESGVEDLSCRSPSGGEHAPSEDSGKDRDSDEAVFLTA

SEQ ID NO: 54794 - protein, 555 aa, Homo sapiens
MEHIRTPKVENVRLVDRVSPKKAALGTLYLTATHVIFVENSPDPRKETWILHSQISTIEKQATTATGCPLLIRCKNFQIIQLIIPQERDCHDVYISLIRLARPVKYEELYCFSFNPMLDKEEREQGWVLIDLSEEYTRMGLPNHYWQLSDVNRDYRVCDSYPTELYVPKSATAHIIVGSSKFRSRRRFPVLSYYYKDNHASICRSSQPLSGFSARCLEDEQMLQAIRKANPGSDFVYVVDTRPKLNAMANRAAGKGYENEDNYSNIKFQFIGIENIHVMRNSLQKMLEVCELKSPSMSDFLWGLENSGWLRHIKAIMDAGIFIAKAVSEEGASVLVHCSDGWDRTAQVCSVASLLLDPHYRTLKGFMVLIEKDWISFGHKFNHRYGNLDGDPKEISPVIDQFIECVWQLMEQFPCAFEFNERFLIHIQHHIYSCQFGNFLCNSQKERRELKIQERTYSLWAHLWKNRADYLNPLFRADHSQTQGTLHLPTTPCNFMYKFWSGMYNRFEKGMQPRQSVTDYLMAVKEETQQLEEELEALEEVRHTCFVNLFSVLIS

SEQ ID NO: 54795 - protein, 590 aa, Homo sapiens
LDLLVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 54796 - protein, 704 aa, Homo sapiens
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEICSTYPPEIVVPKSVTLGTVVGSSKFRSKERVPVLSYLYKENNAAICRCSQPLSGFYTRCVDDELLLEAISQTNPGSQFMYVVDTRPKLNAMANRAAGKGYENEDNYANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 54797 - protein, 508 aa, Homo sapiens
  MOD_RES (1)..(1): Any amino acid
XDSDLVCHEVYISLLKLSQPALPEDLYAFSYNPKSSKEMRESGWKLIDPISDFGRMGIPNRNWTITDANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMILIEKEWISMGHKFSQRCGHLDGDSKEVSPIFTQFLDCIWQLMEQFPCAFEFNENFLLEIHDHVFSCQFGNFLGNCQKDREDLRVYEKTHSVWPFLVQRKPDFRNPLYKGFTMYGVLNPSTVPYNIQFWCGMYNRFDKGLQPKQSMLESLLEIKKQRAMLETDVHELEKKLKVRDEPPEEICTCSQLGNILSQHLGSPLTNPLGFMGINGDLNTLMENGTLSREGGLRAQMDQVKSQGADLHHNCCEIVGSLRAINISGDVGISEAMGISGDMCTFEATGFSKDLGICGAMDISEATGISGNLGISEARGFSGDMGILGDTGISKASTKEADYSKHQ

SEQ ID NO: 54798 - protein, 693 aa, Homo sapiens
MDHITVPKVENVKLVDRYVSKKPANGILYLTATHLIYVEASGAARKETWIALHHIATVEKLPITSLGCPLTLRCKNFRVAHFVLDSDLVCHEVYISLLKLSQPALPEDLYAFSYNPKSSKEMRESGWKLIDPISDFGRMGIPNRNWTITDANRNYEICSTYPPEIVVPKSVTLGTVVGSSKFRSKERVPVLSYLYKENNAAICRCSQPLSGFYTRCVDDELLLEAISQTNPGSQFMYVVDTRPKLNAMANRAAGKGYENEDNYANIRFRFMGIENIHVMRSSLQKLLEVCELKTPTMSEFLSGLESSGWLRHIKAIMDAGIFITKAVKVEKASVLVHCSDGWDRTAQVCSVASILLDPFYRTFKGLMIWHFLVLIMRIVLQLAKMNLMDITKIFSLLQPDKEEEDTDTEEKQALNQAVYDNDSYTLDQLLRQERYKRFINSRSGWGVPGTPLRLAASYGHLSCLQVLLAHGADVDSLDVKAQTPLFTAVSHGHLDCVRVLLEAGASPGGSIYNNCSPVLTAARDGAVAILQELLDHGAEANVKAKLPVWASNIASCSGPLYLAAVYGHLDCFRLLLLHGADPDYNCTDQGLLARVPRPRTLLEICLHHNCEPEYIQLLIDFGANIYLPSLSLDLTSQDDKGIALLLQARATPRSLLSQVRLVVRRALCQAGQPQAINQLDIPPMLISYLKHQL

SEQ ID NO: 54799 - protein, 549 aa, Homo sapiens
MEFAELIKTPRVDNVVLHRPFYPAVEGTLCLTGHHLILSSRQDNTEELWLLHSNIDAIDKRFVGSLGTIIIKCKDFRIIQLDIPGMEECLNIASSIEALSTLDSITLMYPFFYRPMFEVIEDGWHSFLPEQEFELYSSATSEWRLSYVNKEFAVCPSYPPIVTVPKSIDDEALRKVATFRHGGRFPVLSYYHKKNGMVIMRSGQPLTGTNGRRCKEDEKLINATLRAGKRGYIIDTRSLNVAQQTRAKGGGFEQEAHYPQWRRIHKSIERYHILQESLIKLVEACNDQTHNMDRWLSKLEASNWLTHIKEILTTACLAAQCIDREGASILIHGTEGTDSTLQVTSLAQIILEPRSRTIRGFEALIEREWLQAGHPFQQRCAQSAYCNTKQKWEAPVFLLFLDCVWQILRQFPCSFEFNENFLIMLFEHAYASQFGTFLGNNESERCKLKLQQKTMSLWSWVNQPSELSKFTNPLFEANNLVIWPSVAPQSLPLWEGIFLRWNRSSKYLDEAYEEMVNIIEYNKELQAKVNILRRQLAELETEDGMQESP

SEQ ID NO: 54800 - protein, 299 aa, Homo sapiens
MPLSGTPAPNKKRKSSKLIMELTGGGQESSGLNLGKKISVPRDVMLEELSLLTNRGSKMFKLRQMRVEKFIYENHPDVFSDSSMDHFQKFLPTVGGQLGTAGQGFSYSKSNGRGGSQAGGSGSAGQYGSDQQHHLGSGSGAGGTGGPAGQAGRGGAAGTAGVGETGSGDQAGGEGKHITVFKTYISPWERAMGVDPQQKMELGIDLLAYGAKAELPKYKSFNRTAMPYGGYEKASKRMTFQMPKFDLGPLLSEPLVLYNQNLSNRPSFNRTPIPWLSSGEPVDYNVDIGIPLDGETEEL

SEQ ID NO: 54801 - protein, 264 aa, Homo sapiens
MLSHNTMMKQRKQQATAIMKEVHGNDVDGMDLGKKVSIPRDIMLEELSHLSNRGARLFKMRQRRSDKYTFENFQYQSRAQINHSIAMQNGKVDGSNLEGGSQQAPLTPPNTPDPRSPPNPDNIAPGYSGPLKEIPPEKFNTTAVPKYYQSPWEQAISNDPELLEALYPKLFKPEGKAELPDYRSFNRVATPFGGFEKASRMVKFKVPDFELLLLTDPRFMSFVNPLSGRRSFNRTPKGWISENIPIVITTEPTDDTTVPESEDL

SEQ ID NO: 54802 - protein, 251 aa, Homo sapiens
MIPKEQKGPVMAAMGDLTEPVPTLDLGKKLSVPQDLMMEELSLRNNRGSLLFQKRQRRVQKFTFELAASQRAMLAGSARRKVTGTAESGTVANANGPEGPNYRSELHIFPASPGASLGGPEGAHPAAAPAGCVPSPSALAPGYAEPLKGVPPEKFNHTAISKGYRCPWQEFVSYRDYQSDGRSHTPSPNDYRNFNKTPVPFGGPLVGGTFPRPGTPFIPEPLSGLELLRLRPSFNRVAQGWVRNLPESEEL

SEQ ID NO: 54803 - protein, 251 aa, Homo sapiens; identical to SEQ ID NO: 54802

SEQ ID NO: 54804 - protein, 662 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTLIKKYIQRQETISLVVVPSNVDIATTEALSMAQEVDPEGDRTIGILTKPDLVDKGTEDKVVDVVRNLVFHLKKGYMIVKCRGQQEIQDQLSLSEALQREKIFFENHPYFRDLLEEGKATVPCLAEKLTSELITHICKSLPLLENQIKETHQRITEELQKYGVDIPEDENEKMFFLIDKVNAFNQDITALMQGEETVGEEDIRLFTRLRHEFHKWSTIIENNFQEGHKILSRKIQKFENQYRGRELPGFVNYRTFETIVKQQIKALEEPAVDMLHTVTDMVRLAFTDVSIKNFEEFFNLHRTAKSKIEDIRAEQEREGEKLIRLHFQMEQIVYCQDQVYRGALQKVREKELEEEKKKKSWDFGAFQSSSATDSSMEEIFQHLMAYHQEASKRISSHIPLIIQFFMLQTYGQQLQKAMLQLLQDKDTYSWLLKERSDTSDKRKFLKERLARLTQARRRLAQFPG

SEQ ID NO: 54805 - protein, 662 aa, Homo sapiens; identical to SEQ ID NO: 54804

SEQ ID NO: 54806 - protein, 68 aa, Homo sapiens
MVVSEVDIAKADPAAASHPLLLNGDATVAQKNPGSVAENNLCSQYEEKVRPCIDLIDSLRALGVEQDL

SEQ ID NO: 54807 - protein, 201 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYKIKTL

SEQ ID NO: 54808 - protein, 26 aa, Homo sapiens
MVVSEVDIAKADPAAASHPLLLNGDA

SEQ ID NO: 54809 - protein, 197 aa, Homo sapiens
MVVSEVDIAKADPAAASHPLLLNGDATVAQKNPGSVAENNLCSQYEEKVRPCIDLIDSLRALGVEQDLALPAIAVIGDQSSGKSSVLEALSGVALPRGSGIVTRCPLVLKLKKLVNEDKWRGKVSYQDYEIEISDASEVEKEINKAQNAIAGEGMGISHELITLEISSRDVPDLTLIDLPGITRVAVGNQPADIGYK

SEQ ID NO: 54810 - protein, 35 aa, Homo sapiens
MVVSEVDIAKADPAAASHPLLLNGDATVAQKNPGS

SEQ ID NO: 54811 - protein, 77 aa, Homo sapiens
MVVSEVDIAKADPAAASHPLLLNGDATVAQKNPGSVAENNLCSQYEEKVRPCIDLIDSLRALGVEQDLALPAIAVIG

SEQ ID NO: 54812 - protein, 662 aa, Homo sapiens; identical to SEQ ID NO: 54804

SEQ ID NO: 54813 - protein, 715 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSGIVTRCPLVLKLKKQPCEAWAGRISYRNTELELQDPGQVEKEIHKAQNVMAGNGRGISHELISLEITSPEVPDLTIIDLPGITRVAVDNQPRDIGLQIKALIKKYIQRQQTINLVVVPCNVDIATTEALSMAHEVDPEGDRTIGILTKPDLMDRGTEKSVMNVVRNLTYPLKKGYMIVKCRGQQEITNRLSLAEATKKEITFFQTHPYFRVLLEEGSATVPRLAERLTTELIMHIQKSLPLLEGQIRESHQKATEELRRCGADIPSQEADKMFFLIEKIKMFNQDIEKLVEGEEVVRENETRLYNKIREDFKNWVGILATNTQKVKNIIHEEVEKYEKQYRGKELLGFVNYKTFEIIVHQYIQQLVEPALSMLQKAMEIIQQAFINVAKKHFGEFFNLNQTVQSTIEDIKVKHTAKAENMIQLQFRMEQMVFCQDQIYSVVLKKVREEIFNPLGTPSQNMKLNSHFPSNESSVSSFTEIGIHLNAYFLETSKRLANQIPFIIQYFMLRENGDSLQKAMMQILQEKNRYSWLLQEQSETATKRRILKERIYRLTQARHALCQFSSKEIH

SEQ ID NO: 54814 - protein, 14 aa, Homo sapiens
MSKAHKPWPYRRRS

SEQ ID NO: 54815 - protein, 134 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSV

SEQ ID NO: 54816 - protein, 125 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIG

SEQ ID NO: 54817 - protein, 129 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSS

SEQ ID NO: 54818 - protein, 201 aa, Homo sapiens
MSKAHKPWPYRRRSQFSSRKYLKKEMNSFQQQPPPFGTVPPQMMFPPNWQGAEKDAAFLAKDFNFLTLNNQPPPGNRSQPRAMGPENNLYSQYEQKVRPCIDLIDSLRALGVEQDLALPAIAVIGDQSSGKSSVLEALSGVALPRGSAQNVMAGNGRGISHELISLEITSPEVPDLTIIDLPGITRVAVDNQPRDIGLQVS

SEQ ID NO: 54819 - protein, 220 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKRISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 54820 - protein, 235 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKSNRAALHLYSNTLNFQISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 54821 - protein, 131 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKRSVKWSPNTMQMGRTPMP

SEQ ID NO: 54822 - protein, 177 aa, Homo sapiens
MIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 54823 - protein, 242 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 54824 - protein, 242 aa, Homo sapiens; identical to SEQ ID NO: 54823

SEQ ID NO: 54825 - protein, 190 aa, Homo sapiens
MTEVVPSSALSEVSLRLLCHDDIDTVKHLCGDWFPIEYPDSWYRDITSNKKFFSLAATYRGAIVGMIVAEIKNRTKIHKEDGDILASNFSVDTQVAYILSLGVVKEFRKHGIEPHGLHPAPGLCTSQPEPLLHSAQSLPPGPQPALQLPAMVGHLFQEWHRVQPDHVMSAGQPPPGPTLRPPAEPAFLSI

SEQ ID NO: 54826 - protein, 249 aa, Homo sapiens
MFPRRRTERRLGDTGTRKKIAYRKAVPGGRKCGASLSWEKSSREYPDSWYRDITSNKKFFSLAATYRGAIVGMIVAEIKNRTKIHKEDGDILASNFSVDTQVAYILSLGVVKEFRKHGIGSLLLESLKDHISTTAQDHCKAIYLHVLTTNNTAINFYENRDFKQHHYLPYYYSIRGVLKDGFTYVLYINGGHPPWTILDYIQHLGSALASLSPCSIPHRVYRQAHSLLCSFLPWSGISSKSGIEYSRTM

SEQ ID NO: 54827 - protein, 163 aa, Homo sapiens
MAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 54828 - protein, 207 aa, Homo sapiens
MGKCSGRCTLVAFCCLQLVAALERQIFDFLGYQWAPILANFLHIMAVILGIFGTVQYRSRYLILYAAWLVLWVGWNAFIICFYLEVGQLSQDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 54829 - protein, 136 aa, Homo sapiens
MAVILGIFGTVQYRSRYLILDRDFIMTFNTSLHRSWWMENGPGCLVTPVLNSRLALEDHHVISVTGCLLDYPYIEALSSALQIFLALFGFVFACYVSKVFLEEEDSFDFIGGFDSYGYQAPQKTSHLQLQPLYTSG

SEQ ID NO: 54830 - protein, 188 aa, Homo sapiens
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLAVSVGSQPLLLVPLGLFYFCANSVHTNGICG

SEQ ID NO: 54831 - protein, 208 aa, Homo sapiens
MGYCSGRCTLIFICGMQLVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 54832 - protein, 207 aa, Homo sapiens
MGIIRFLLLYCPTNILTVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYMSK

SEQ ID NO: 54833 - protein, 191 aa, Homo sapiens
MKIVCVLERQIFDFLGYQWAPILANFVHIIIVILGLFGTIQYRPRYITGYAVWLVLWVTWNVFVICFYLEAGDLSKETDLILTFNISMHRSWWMENGPGCTVTSVTPAPDWAPEDHRYITVSGCLLEYQYIEVAHSSLQIVLALAGFIYACYVVKCITEEEDSFDFIGGFDSYGYQGPQKTSHLQLQPMYM

SEQ ID NO: 54834 - protein, 139 aa, Homo sapiens
MGYCSGRCTLIFICGMQLVCVLERQIFDFLGYQWAPILANFVHIIIVILGLFGTIQYRPRYITGYAVWLVLWVTWNVFVICFYLEAGDLSKLAGFIYACYVVKCITEEEDSFDFIGGFDSYGYQGPQKTSHLQLQPMYM

SEQ ID NO: 54835 - protein, 197 aa, Homo sapiens
MGCCTGRCSLICLCALQLVSALERQIFDFLGFQWAPILGNFLHIIVVILGLFGTIQYRPRYIMVYTVWTALWVTWNVFIICFYLEVGGLSKDTDLMTFNISVHRSWWREHGPGCVRRVLPPSAHGMMDDYTYVSVTGCIVDFQYLEVIHSAVQILLSLVGFVYACYVISISMEEEDTYSCDLQVCKHLFIQMLQIIE

SEQ ID NO: 54836 - protein, 197 aa, Homo sapiens; identical to SEQ ID NO: 54835

SEQ ID NO: 54837 - protein, 161 aa, Homo sapiens
MGCCTGRCSLICLCALQLVSWVFDRQIFLLSFQWAPILGNFLHIIVVILGLFGTIQYRPRYIMVYTVWTALWVTWNVFIICFYLEVGGLSKDTDLMTFNISVHRSWWREHGPGCVRRVLPPSAHGMMDDYTYVSVTGCIVDFQYLEVIHSAVQILLSIFFL

SEQ ID NO: 54838 - protein, 208 aa, Homo sapiens
MGSCSGRCALVVLCAFQLVAALERQVFDFLGYQWAPILANFVHIIIVILGLFGTIQYRLRYVMVYTLWAAVWVTWNVFIICFYLEVGGLLKDSELLTFSLSRHRSWWRERWPGCLHEEVPAVGLGAPHGQALVSGAGCALEPSYVEALHSCLQILIALLGFVCGCQVVSVFTEEEDSFDFIGGFDPFPLYHVNEKPSSLLSKQVYLPA

SEQ ID NO: 54839 - protein, 88 aa, Homo sapiens
MAESRGRLYLWMCLAAALASFLMGFMVGWFIKPLKETTTSVRYHQSIRWKLVSEMKAENIKSFLRSFTKLPHLAGTEQNFLLAKKIQT

SEQ ID NO: 54840 - protein, 740 aa, Homo sapiens
MAESRGRLYLWMCLAAALASFLMGFMVGWFIKPLKETTTSVRYHQSIRWKLVSEMKAENIKSFLRSFTKLPHLAGTEQNFLLAKKIQTQWKKFGLDSAKLVHYDVLLSYPNETNANYISIVDEHETEIFKTSYLEPPPDGYENVTNIVPPYNAFSAQGMPEGDLVYVNYARTEDFFKLEREMGINCTGKIVIARYGKIFRGNKVKNAMLAGAIGIILYSDPADYFAPEVQPYPKGWNLPGTAAQRGNVLNLNGAGDPLTPGYPAKEYTFRLDVEEGVGIPRIPVHPIGYNDAEILLRYLGGIAPPDKSWKGALNVSYSIGPGFTGSDSFRKVRMHVYNINKITRIYNVVGTIRGSVEPDRYVILGGHRDSWVFGAIDPTSGVAVLQEIARSFGKLMSKGWRPRRTIIFASWDAEEFGLLGSTEWAEENVKILQERSIAYINSDSSIEGNYTLRVDCTPLLYQLVYKLTKEIPSPDDGFESKSLYESWLEKDPSPENKNLPRINKLGSGSDFEAYFQRLGIASGRARYTKNKKTDKYSSYPVYHTIYETFELVEKFYDPTFKKQLSVAQLRGALVYELVDSKIIPFNIQDYAEALKNYAASIYNLSKKHDQQLTDHGVSFDSLFSAVKNFSEAASDFHKRLIQVDLNNPIAVRMMNDQLMLLERAFIDPLGLPGKLFYRHIIFAPSSHNKYAGESFPGIYDAIFDIENKANSRLAWKEVKKHISIAAFTIQAAAGTLKEVL

SEQ ID NO: 54841 - protein, 544 aa, Homo sapiens
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPRARLQPGSTPPTTQPLTPLTMWTSFWTRASAAIRLWPGQRGV

SEQ ID NO: 54842 - protein, 522 aa, Homo sapiens
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPRLQQPSGCGPDSGECDSPAQ

SEQ ID NO: 54843 - protein, 740 aa, Homo sapiens
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRTGSVVTFPGLSNACSRARDTASGSEAWAEVQRQLSIVVTALEGAAATLRPVADL

SEQ ID NO: 54844 - protein, 739 aa, Homo sapiens
MQWTKVLGLGLGAAALLGLGIILGHFAIPKKANSLAPQDLDLEILETVMGQLDAHRIRENLRELSREPHLASSPRDEDLVQLLLQRWKDPESGLDSAEASTYEVLLSFPSQEQPNVVDIVGPTGGIIHSCHRTEENVTGEQGGPDVVQPYAAYAPSGTPQGLLVYANRGAEEDFKELQTQGIKLEGTIALTRYGGVGRGAKAVNAAKHGVAGVLVYTDPADINDGLSSPDETFPNSWYLPPSGVERGSYYEYFGDPLTPYLPAVPSSFRVDLANVSGFPPIPTQPIGFQDARDLLCNLNGTLAPATWQGALGCHYRLGPGFRPDGDFPADSQVNVSVYNRLELRNSSNVLGIIRGAVEPDRYVLYGNHRDSWVHGAVDPSSGTAVLLELSRVLGTLLKKGTWRPRRSIVFASWGAEEFGLIGSTEFTEEFFNKLQERTVAYINVDISVFANATLRVQGTPPVQSVVFSATKEIRSPGPGDLSIYDNWIRYFNRSSPVYGLVPSLGSLGAGSDYAPFVHFLGISSMDIAYTYDRSKTSARIYPTYHTAFDTFDYVDKFLDPGFSSHQAVARTAGSVILRLSDSFFLPLKVSDYSETLRSFLQAAQQDLGALLEQHSISLGPLVTAVEKFEAEAAALGQRISTLQKGSPDPLQVRMLNDQLMLLERTFLNPRAFPEERYYSHVLWAPRGLRSHIPGLSNACSRARDTASGSEAWAEVQRQLSIVVTALEGAAATLRPVADL

SEQ ID NO: 54845 - protein, 134 aa, Homo sapiens
MEISKKIKTQWTSLGLEDVQFVNYSVLLDLPGPSPSTVTLSSSGQCFHPNGQPCSEEARKDSSQDLLYSYAAYSAKGTLKAEVIDVSYGMADDLKRIRKIKNVTNQIALLKLGKLPLLYKMKVLDKADQTSPLY

SEQ ID NO: 54846 - protein, 795 aa, Homo sapiens
MGENEASLPNTSLQGKKMAYQKVHADQRAPGHSQYLDNDDLQATALDLEWDMEKELEESGFDQFQLDGAENQNLGHSETIDLNLDSIQPATSPKGRFQRLQEESDYITHYTRSAPKSNRCNFCHVLKILCTATILFIFGILIGYYVHTNCPSDAPSSGTVDPQLYQEILKTIQAEDIKKSFRNLVQLYKNEDDMEISKKIKTQWTSLGLEDVQFVNYSVLLDLPGPSPSTVTLSSSGQCFHPNGQPCSEEARKDSSQDLLYSYAAYSAKGTLKAEVIDVSYGMADDLKRIRKIKNVTNQIALLKLGKLPLLYKLSSLEKAGFGGVLLYIDPCDLPKTVNPSHDTFMVSLNPGGDPSTPGYPSVDESFRQSRSNLTSLLVQPISAPLVAKLISSPKARTKNEACSSLELPNNEIRVVSMQVQTVTKLKTVTNVVGFVMGLTSPDRYIIVGSHHHTAHSYNGQEWASSTAIITAFIRALMSKVKRGWRPDRTIVFCSWGGTAFGNIGSYEWGEDFKKVLQKNVVAYISLHSPIRGNSSLYPVASPSLQQLVVEKNNFNCTRRAQCPETNISSIQIQGDADYFINHLGVPIVQFAYEDIKTLEGPSFLSEARFSTRATKIEEMDPSFNLHETITKLSGEVILQIANEPVLPFNALDIALEVQNNLKGDQPNTHQLLAMALRLRESAELFQSDEMRPANDPKERAPIRIRMLNDILQDMEKSFLVKQAPPGFYRNILYHLDEKTSRFSILIEAWEHCKPLASNETLQEALSEVLNSINSAQVYFKAGLDVFKSVLDGKN

SEQ ID NO: 54847 - protein, 411 aa, Homo sapiens
MLLKTVLLLGHVAQVLMLDNGLLQTPPMGWLAWERFRCNINCDEDPKNCISEQLFMEMADRMAQDGWRDMGYTYLNIDDCWIGGRDASGRLMPDPKRFPHGIPFLADYVHSLGLKLGIYADMGNFTCMGYPGTTLDKVVQDAQTFAEWKVDMLKLDGCFSTPEERAQGYPKMAAALNATGRPIAFSCSWPAYEGGLPPRVNYSLLADICNLWRNYDDIQDSWWSVLSILNWFVEHQDILQPVAGPGHWNDPDMLLIGNFGLSLEQSRAQMALWTVLAAPLLMSTDLRTISAQNMDILQNPLMIKINQDPLGIQGRRIHKEKSLIEVYMRPLSNKASALVFFSCRTDMPYRYHSSLGQLNFTGSVIYEAQDVYSGDIISGLRDETNFTVIINPSGVVMWYLYPIKNLEMSQQ

SEQ ID NO: 54848 - protein, 411 aa, Homo sapiens; identical to SEQ ID NO: 54847

SEQ ID NO: 54849 - protein, 411 aa, Homo sapiens; identical to SEQ ID NO: 54847

SEQ ID NO: 54850 - protein, 344 aa, Homo sapiens
MAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 54851 - protein, 390 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFDKCRFAGFCRKIAEGAQQGDPLSRYIFRKAGEMLGRHIVAVLPEIDPVLFQGKIGLPILCVGSVWKSWELLKEGFLLALTQGREIQAQNFFSSFTLMKLRHSSALGGASLGARHIGHLLPMDYSANAIAFYSYTFS

SEQ ID NO: 54852 - protein, 515 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEECPLGWHGPGCQRPCKCEHHCPCDPKTGNCSVSRVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 54853 - protein, 481 aa, Homo sapiens
MATSTGRWLLLRLALFGFLWEASGGLDSGASRDDDLLLPYPRARARLPRDCTRVRAGNREHESWPPPPATPGAGGLAVRTFVSHFRDRAVAGHLTRAVEPLRTFSVLEPGGPGGCAARRRATVEETARAADCRVAQNGGFFRMNSGECLGNVVSDERRVSSSGGLQNAQFGIRRDGTLVTGYLSEEEVLDTENPFVQLLSGVVWLIRNGSIYINESQATECDETQETGSFSKFVNVISARTAIGHDRKGQLVLFHADGQTEQRGINLWEMAEFLLKQDVVNAINLDGGGSATFVLNGTLASYPSDHCQDNMWRCPRQVSTVVCVHEPRCQPPDCHGHGTCVDGHCQCTGHFWRGPGCDELDCGPSNCSQHGLCTETGCRCDAGWTGSNCSEVKQCLQPPEATLRAGELSFFTRTAWLALTLALAFLLLISTAANLSLLLSRAERNRRLHGDYAYHPLQEMNGEPLAAEKEQPGGAHNPFKD

SEQ ID NO: 54854 - protein, 743 aa, Homo sapiens
MEAVAVAAAVGVLLLAGAGGAAGDEAREAAAVRALVARLLGPGPAADFSVSVERALAAKPGLDTYSLGGGGAARVRVRGSTGVAAAAGLHRYLRDFCGCHVAWSGSQLRLPRPLPAVPGELTEATPNRYRYYQNVCTQSYSFVWWDWARWEREIDWMALNGINLALAWSGQEAIWQRVYLALGLTQAEINEFFTGPAFLAWGRMGNLHTWDGPLPPSWHIKQLYLQHRVLDQMRSFGMTPVLPAFAGHVPEAVTRVFPQVNVTKMGSWGHFNCSYSCSFLLAPEDPIFPIIGSLFLRELIKEFGTDHIYGADTFNEMQPPSSEPSYLAAATTAVYEAMTAVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 54855 - protein, 419 aa, Homo sapiens
PQCCLHSRGMFPRLSPVDTEAVWLLQGWLFQHQPQFWGPAQIRAVLGAVPRGRLLVLDLFAESQPVYTRTASFQGQPFIWCMLHNFGGNHGLFGALEAVNGGPEAARLFPNSTMVGTGMAPEGISQNEVVYSLMAELGWRKDPVPDLAAWVTSFAARRYGVSHPDAGAAWRLLLRSVYNCSGEACRGHNRSPLVRRPSLQMNTSIWYNRSDVFEAWRLLLTSAPSLATSPAFRYDLLDLTRQAVQELVSLYYEEARSAYLSKELASLLRAGGVLAYELLPALDEVLASDSRFLLGSWLEQARAAAVSEAEADFYEQNSRYQLTLWGPEGNILDYANKQLAGLVANYYTPRWRLFLEALVDSVAQGIPFQQHQFDKNVFQLEQAFVLSKQRYPSQPRGDTVDLAKKIFLKYYPRWVAGSW

SEQ ID NO: 54856 - protein, 320 aa, Homo sapiens
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 54857 - protein, 109 aa, Homo sapiens
MAFPKKKLQGLVAATITPMTENGEINFSVIGQYVDYLVKEQGVKNIFVNGTTGEGLSLSVSERRQVAEEWVTKGKDKSNHHKLGTIRTTQSRRSSFRRQLKAWHSGSHL

SEQ ID NO: 54858 - protein, 185 aa, Homo sapiens
MSRAPGILASWRRAPSLSVQKGSQTARHTCHPEVPLGNCFLPVYKASPLTVTRLWAERLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEHL

SEQ ID NO: 54859 - protein, 240 aa, Homo sapiens
MAFPKKKLQGLVAATITPMTENGEINFSVIGQYVDYLVKEQGVKNIFVNGTTGEGLSLSVSERRQVAEEWVTKGKDKLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEFCIQRFINFVVKLENSKLKVSKNQRTLPLGTTNFPFLH

SEQ ID NO: 54860 - protein, 320 aa, Homo sapiens; identical to SEQ ID NO: 54856

SEQ ID NO: 54861 - protein, 301 aa, Homo sapiens
MSRAPGILASWRRAPSLSVQKGSQTARHTCHPEVPLGNCFLPVYKASPLTVTRLWAERLDQVIIHVGALSLKESQELAQHAAEIGADGIAVIAPFFLKPWTKDILINFLKEVAAAAPALPFYYYHIPALTGVKIRAEELLDGILDKIPTFQGLKFSDTDLLDFGQCVDQNRQQQFAFLFGVDEQLLSALVMGATGAVGSTYNYLGKKTNQMLEAFEQKDFSLALNYQFCIQRFINFVVKLGFGVSQTKAIMTLVSGIPMGPPRLPLQKASREFTDSAEAKLKSLDFLSFTDLKDGNLEAGS

SEQ ID NO: 54862 - protein, 240 aa, Homo sapiens; identical to SEQ ID NO: 54859

SEQ ID NO: 54863 - protein, 207 aa, Homo sapiens
REGQKGSQTARHTCHPEVPLGNCFLPVYKASPLTVTRLWAERLDQVIIHVGALSLKESQELAQHAAEIGADGIAVIAPFFLKPWTKDILINFLKEVAAAAPALPFYYYHIPALTGVKTTVECSGDGSNWSSGQFCIQRFINFVVKLGFGVSQTKAIMTLVSGIPMGPPRLPLQKASREFTDSAEAKLKSLDFLSFTDLKDGNLEAGS

SEQ ID NO: 54864 - protein, 248 aa, Homo sapiens
MGLSRVRAVFFDLDNTLIDTAGASRRGMLEVIKLLQSKYHYKEEAEIICDKVQVKLSKECFHPYNTCITDLRTSHWEEAIQETKGGAANRKLAEECYFLWKSTRLQHMTLAEDVKAMLTELRKEVRLLLLTNGDRQTQREKIEACACQSYFDAVVVGGEQREEKPAPSIFYYCCNLLGVQPGDCVMVGDTLETDIQGGLNAGLKATVWINKNGIVPLKSSPVPHYMVSSVLELPALLQSIDCKVSMST

SEQ ID NO: 54865 - protein, 359 aa, Homo sapiens
MPLELELCPGRWVGGQHPCFIIAEIGQNHQGDLDVAKRMIRMAKECGADCAKFQKSELEFKFNRKALERPYTSKHSWGKTYGEHKRHLEFSHDQYRELQRYAEEVGIFFTASGMDEMAVEFLHELNVPFFKVGSGDTNNFPYLEKTAKKGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLLPCEMACNEKLGKSVVAKVKIPEGTILTMDMLTVKVGEPKGYPPEDIFNLVGKKVLVTVEEDDTIMEELVDNHGKKIKS

SEQ ID NO: 54866 - protein, 140 aa, Homo sapiens
MVLVLDYSGRPMVISSGMQSMDTMKQVYQIVKPLNPNFCFLQCTSAYPLQPEDVNLRVISEYQKLFPDIPIGYSGHETGIAISVAAVALGAKVLERHITLDKTWKGSDHSASLEPGELAELVRSVRLVERALGSPTKQLL

SEQ ID NO: 54867 - protein, 115 aa, Homo sapiens
EDVNLRVISEYQKLFPDIPIGYSGHETGIAISVAAVALGAKVLERHITLDKTWKGSDHSASLEPGELAELVRSVRLVERALGSPTKQLLPCEMACNEKVCPAGLYSVLLPCVEKG

SEQ ID NO: 54868 - protein, 290 aa, Homo sapiens
MDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 54869 - protein, 290 aa, Homo sapiens; identical to SEQ ID NO: 54868

SEQ ID NO: 54870 - protein, 290 aa, Homo sapiens; identical to SEQ ID NO: 54868

SEQ ID NO: 54871 - protein, 290 aa, Homo sapiens; identical to SEQ ID NO: 54868

SEQ ID NO: 54872 - protein, 290 aa, Homo sapiens; identical to SEQ ID NO: 54868

SEQ ID NO: 54873 - protein, 290 aa, Homo sapiens; identical to SEQ ID NO: 54868

SEQ ID NO: 54874 - protein, 290 aa, Homo sapiens; identical to SEQ ID NO: 54868

SEQ ID NO: 54875 - protein, 352 aa, Homo sapiens
MLLLLLHKEAALEPQGPAVGYNSLPVSDDHHVSGIQARKKQQSVFWIKTEDQPTFNLLRKGIMDIEAYLERIGYKKSRNKLDLETLTDILQHQIRAVPFENLNIHCGDAMDLGLEAIFDQVVRRNRGGWCLQVNHLLYWALTTIGFETTMLGGYVYSTPAKKYSTGMIHLLLQVTIDGRNYIVDAGFGRSYQMWQPLELISGKDQPQVPCVFRLTEENGFWYLDQIRREQYIPNEEFLHSDLLEDSKYRKIYSFTLKPRTIEDFESMNTYLQTSPSSVFTSKSFCSLQTPDGVHCLVGFTLTHRRFNYKDNTDLIEFKTLSEEEIEKVLKNIFNISLQRKLVPKHGDRFFTI

SEQ ID NO: 54876 - protein, 290 aa, Homo sapiens
MDIEAYFERIGYKNSRNKLDLETLTDILEHQIRAVPFENLNMHCGQAMELGLEAIFDHIVRRNRGGWCLQVNQLLYWALTTIGFQTTMLGGYFYIPPVNKYSTGMVHLLLQVTIDGRNYIVDAGSGSSSQMWQPLELISGKDQPQVPCIFCLTEERGIWYLDQIRREQYITNKEFLNSHLLPKKKHQKIYLFTLEPRTIEDFESMNTYLQTSPTSSFITTSFCSLQTPEGVYCLVGFILTYRKFNYKDNTDLVEFKTLTEEEVEEVLRNIFKISLGRNLVPKPGDGSLTI

SEQ ID NO: 54877 - protein, 227 aa, Homo sapiens
MAPCHIRKYQESDRQWVVGLLSRGMAEHAPATFRQLLKLPRTLILLLGGPLALLLVSGSWLLALVFSISLFPALWFLAKKPWTEYVDMTLCTDMSDITKSYLSERGSCFWVAESEEKVVGMVGALPVDDPTLREKRLQLFHLFVDSEHRRQGIAKALVRTVLQFARDQGYSEVILDTGTIQLSAMALYQSMGFKKTGQSFFCVWARLVALHTVHFIYHLPSSKVGSL

SEQ ID NO: 54878 - protein, 134 aa, Homo sapiens
MADIEQYYMKPPGSCFWVAVLDGNVVGIVAARAHEEDNTVELLRMSVDSRFRGKGIAKALGRKVLEFAVVHNYSAVVLGTTAVKVAAHKLYESLGFRHMGASDHYVLPGMTLSLAERLFFQVRYHRYRLQLREE

SEQ ID NO: 54879 - protein, 302 aa, Homo sapiens
MHCGPPDMVCETKIVAAEDHEALPGAKKDALLAAAGAMWPPLPAAPGPAAAPPAPPPAPVAQPHGGAGGAGPPGGRGVCIREFRAAEQEAARRIFYDGIMERIPNTAFRGLRQHPRAQLLYALLAALCFAVSRSLLLTCLVPAALLGLRYYYSRKVIRAYLECALHTDMADIEQYYMKPPGSCFWVAVLDGNVVGIVAARAHEEDNTVELLRMSVDSRFRGKGIAKALGRKVLEFAVVHNYSAVVLGTTAVKVAAHKLYESLGFRHMGASDHYVLPGMTLSLAERLFFQVRYHRYRLQLREE

SEQ ID NO: 54880 - protein, 393 aa, Homo sapiens
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNDDENF

SEQ ID NO: 54881 - protein, 124 aa, Homo sapiens
MDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAG

SEQ ID NO: 54882 - protein, 393 aa, Homo sapiens; identical to SEQ ID NO: 54880

SEQ ID NO: 54883 - protein, 5 aa, Homo sapiens
MDENE

SEQ ID NO: 54884 - protein, 393 aa, Homo sapiens; identical to SEQ ID NO: 54880

SEQ ID NO: 54885 - protein, 466 aa, Homo sapiens
MARRRELKRCLQLLASSAEPARRARVRKNPSACRGRPSRYAAALCAGTLWPEAAELRRRALPATPSASSSPKDMDENESNQSLMTSSQYPKEAVRKRQNSARNSGASDSSRFSRKSFKLDYRLEEDVTKSKKGKDGRFVNPWPTWKNPSIPNVLRWLIMEKDHSSVPSSKEELDKELPVLKPYFITNPEEAGVREAGLRVTWLGHATVMVEMDELIFLTDPIFSSRASPSQYMGPKRFRRSPCTISELPPIDAVLISHNHYDHLDYNSVIALNERFGNELRWFVPLGLLDWMQKCGCENVIELDWWEENCVPGHDKVTFVFTPSQHWCKRTLMDDNKVLWGSWSVLGPWNRFFFAGDTGYCPAFEEIGKRFGPFDLAAIPIGAYEPRWFMKYQHVDPEEAVRIHTDVQTKKSMAIHWGTFALANEHYLEPPVKLNEALERYGLNAEDFFVLKHGESRYLNNDDENF

SEQ ID NO: 54886 - protein, 393 aa, Homo sapiens; identical to SEQ ID NO: 54880

SEQ ID NO: 54887 - protein, 732 aa, Homo sapiens
MERQVLLSEPEEAAALYRGLSRQPALSAACLGPEVTTQYGGQYRTVHTEWTQRDLERMENIRFCRQYLVFHDGDSVVFAGPAGNSVETRGELLSRESPSGTMKAVLRKAGGTGPGEEKQFLEVWEKNRKLKSFNLSALEKHGPVYEDDCFGCLSWSHSETHLLYVAEKKRPKAESFFQTKALDVSASDDEIARLKKPDQAIKGDQFVFYEDWGENMVSKSIPVLCVLDVESGNISVLEGVPENVSPGQAFWAPGDAGVVFVGWWHEPFRLGIRFCTNRRSALYYVDLIGGKCELLSDDSLAVSSPRLSPDQCRIVYLQYPSLIPHHQCSQLCLYDWYTKVTSVVVDVVPRQLGENFSGIYCSLLPLGCWSADSQRVVFDSAQRSRQDLFAVDTQVGTVTSLTAGGSGGSWKLLTIDQDLMVAQFSTPSLPPTLKVGFLPSAGKEQSVLWVSLEEAEPIPDIHWGIRVLQPPPEQENVQYAGLDFEAILLQPGSPPDKTQVPMVVMPHGGPHSSFVTAWMLFPAMLCKMGFAVLLVNYRGSTGFGQDSILSLPGNVGHQDVKDVQFAVEQVLQEEHFDASHVALMGGSHGGFISCHLIGQYPETYRACVARNPVINIASMLGSTDIPDWCVVEAGFPFSSDCLPDLSVWAEMLDKSPIRYIPQVKTPLLLMLGQEDRRVPFKQGMEYYRALKTRNVPVRLLLYPKSTHALSEVEVESDSFMNAVLWLRTHLGS

SEQ ID NO: 54888 - protein, 610 aa, Homo sapiens
VLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFSSSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQNHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54889 - protein, 622 aa, Homo sapiens
MDSEKSSEWRSDVLNRLQSKYGSLYRRDNVILSGTHTHSGPAGYFQYTVFVIASEGFSNQTFQHMVTGILKSIDIAHTNMKPGKIFINKGNVDGVQINRSPYSYLQNPQSERARYSSNTDKEMIVLKMVDLNGDDLGLISWFAIHPVSMNNSNHLVNSDNVGYASYLLEQEKNKGYLPGQGPFVAAFSSSNLGDVSPNILGPRCINTGESCDNANSTCPIGGPSMCIAKGPGQDMFDSTQIIGRAMYQRAKELYASASQEVTGPLASAHQWVDMTDVTVWLNSTHASKTCKPALGYSFAAGTIDGVGGLNFTQGKTEGDPFWDTIRDQILGKPSEEIKECHKPKPILLHTGELSKPHPWHPDIVDVQIITLGSLAITAIPGEFTTMSGRRLREAVQAEFASHGMQNMTVVISGLCNVYTHYITTYEEYQAQRYEAASTIYGPHTLSAYIQLFRNLAKAIATDTVANLSRGPEPPFFKQLIVPLIPSIVDRAPKGRTFGDVLQPAKPEYRVGEVAEVIFVGANPKNSVQNQNHQTFLTVEKYEATSTSWQIVCNDASWETRFYWHKGLLGLSNATVEWHIPDTAQPGIYRIRYFGHNRKQDILKPAVILSFEGTSPAFEVVTI

SEQ ID NO: 54890 - protein, 446 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIMHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEEEEEEEEEG

SEQ ID NO: 54891 - protein, 446 aa, Homo sapiens; identical to SEQ ID NO: 54890

SEQ ID NO: 54892 - protein, 414 aa, Homo sapiens
MGRPRVRQAWPGCCGHTGRLPAGRGYLASHMCDPAGAELIGDGMSDPTPPSNACTGHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEEEEEEEEEG

SEQ ID NO: 54893 - protein, 591 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIIATPLSLASQLLPSPAVSHSGQGGVTGQVHVLPQPSDQGVLSGPRAARGQTAPQEEAVTQEEVEALVCGHTQRWVPGPVYDAAAGGSGWAQLSLRAGMGVGQATGHIQDPASQRLTWNKSPKSVLVIKKMRDASLLQPFKELCTHLMEARGAGGKGAWGAHGVGGASIHITAPRVGSAGGMSRLALCFQENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRSRLKVRVVKELRGKKTAVHNGLGENGSQAAGLDMDVGKQAMQYQVLNEVVIDRGPSSYLSNVDVYLDGHLITTVQGDGVIVSTPTGSTAYAAAAGASMIHPNVPAIMITPICPHSLSFRPIVVPAGVELKIMLSPEARNTAWVSFDGRKRQEIRHGDSISITTSCYPLPSICVRDPVSDWFESLAQCLHWNVRKKQAHFEEEEEEEEEG

SEQ ID NO: 54894 - protein, 591 aa, Homo sapiens; identical to SEQ ID NO: 54893

SEQ ID NO: 54895 - protein, 206 aa, Homo sapiens
MGRPRVRQAWPGCCGHTGRLPAGRGYLASHMCDPAGAELIGDGMSDPTPPSNACTGHIQDPASQRLTWNKSPKSVLVIKKMRDASLLQPFKELCTHLMEENMIVYVEKKVLEDPAIASDESFGAVKKKFCTFREDYDDISNQIDFIICLGGDGTLLYASSLFQGSVPPVMAFHLGSLGFLTPFSFENFQSQVTQVIEGNAAVVLRS

SEQ ID NO: 54896 - protein, 706 aa, Homo sapiens
MGRKVTVATCALNQWALDFEGNLQRILKSIEIAKNRGARYRLGPELEICGYGCWDHYYESDTLLHSFQVLAALVESPVTQDIICDVGMPVMHRNVRYNCRVIFLNRKILLIRPKMALANEGNYRELRWFTPWSRSRHTEEYFLPRMIQDLTKQETVPFGDAVLVTWDTCIGSEICEELWTPHSPHIDMGLDGVEIITNASGSHQVLRKANTRVDLVTMVTSKNGGIYLLANQKGCDGDRLYYDGCAMIAMNGSVFAQGSQFSLDDVEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 54897 - protein, 446 aa, Homo sapiens
MGISGQEVLTATLDLEDVRSYRAEISSRNLAASRASPYPRVKVDFALSCHEDLLAPISEPIEWKYHSPEEEISLGPACWLWDFLRRSQQAGFLLPLSGGVDSAATACLIYSMCCQVCEAVRSGNEEVLADVRTIVNQISYTPQDPRDLCGRILTTCYMASKNSSQETCTRARELAQQIGSHHISLNIDPAVKAVMGIFSLVTGKSPLFAAHGGSSRENLALQNVQARIRMVLAYLFAQLSLWSRGVHGGLLVLGSANVDESLLGYLTKYDCSSADINPIGGISKTDLRAFVQFCIQRFQLPALQSILLAPATAELEPLADGQVSQTDEEDMGMTYAELSVYGKLRKVAKMGPYSMFCKLLGMWRHICTPRQVADKVKRFFSKYSMNRHKMTTLTPAYHAENYSPEDNRFDLRPFLYNTSWPWQFRCIENQVLQLERAEPQSLDGVD

SEQ ID NO: 54898 - protein, 373 aa, Homo sapiens
MEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQLSRDSTLGGKAFHITNDEPIPFWTFLSRILTGLNYEAPKYHIPYWVAYYLALLLSLLVMVISPVIQLQPTFTPMRVALAGTFHYYSCERAKKAMGYQPLVTMDDAMERTVQSFRHLRRVK

SEQ ID NO: 54899 - protein, 254 aa, Homo sapiens
MEPAVSEPMRDQVARTHLTEDTPKVNADIEKVNQNQAKRCTVIGGSGFLGQHMVEQLLARGYAVNVFDIQQGFDNPQVRFFLGDLCSRQDLYPALKGVNTVFHCASPPPSSNNKELFYRVNYIGTKNVIETCKEAGVQKLILTSSASVIFEGVDIKNGTEDLPYAMKPIDYYTETKILQERAVLGANDPEKNFLTTAIRPHGIFGPRDPQLVPILIEAARNGKMKFVIGNGKNLVDFTFVENVVHGHILAAEQL

SEQ ID NO: 54900 - protein, 373 aa, Homo sapiens; identical to SEQ ID NO: 54898

SEQ ID NO: 54901 - protein, 274 aa, Homo sapiens
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54902 - protein, 236 aa, Homo sapiens
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQSKKAVLSITTGGSGSMYSLQGIHGDMNVILWPIQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54903 - protein, 240 aa, Homo sapiens
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQFPLQWFGVPAILKGWFERVFIGEFAYTYAAMYDKGPFRSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54904 - protein, 202 aa, Homo sapiens
MVGRRALIVLAHSERTSFNYAMKEAAAAALKKKGWEVVESDLYAMNFNPIISRKDITGKLKDPANFQYPAESVLAYKEGHLSPDIVAEQKKLEAADLVIFQSGILHFCGFQVLEPQLTYSIGHTPADARIQILEGWKKRLENIWDETPLYFAPSSLFDLNFQAGFLMKKEVQDEEKNKKFGLSVGHHLGKSIPTDNQIKARK

SEQ ID NO: 54905 - protein, 231 aa, Homo sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 54906 - protein, 231 aa, Homo sapiens; identical to SEQ ID NO: 54905

SEQ ID NO: 54907 - protein, 193 aa, Homo sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQGKLALLSVTTGGTAEMYTKTGVNGDSRYFLWPLQHGTLHFCGFKVLAPQISFAPEIASEEERKGMVAAWSQRLQTIWKEEPIPCTAHWHFGQ

SEQ ID NO: 54908 - protein, 193 aa, Homo sapiens; identical to SEQ ID NO: 54907

SEQ ID NO: 54909 - protein, 231 aa, Homo sapiens; identical to SEQ ID NO: 54905

SEQ ID NO: 54910 - protein, 139 aa, Homo sapiens
MAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQFPLYWFSVPAILKGWMDRVLCQGFAFDIPGFYDSGLLQ

SEQ ID NO: 54911 - protein, 139 aa, Homo sapiens; identical to SEQ ID NO: 54910

SEQ ID NO: 54912 - protein, 63 aa, Homo sapiens
MAGKKVLIVYAHQEPKSFNGSLKNVAVDELSRQGCTVTVSDLYAMNLEPRATDKDITGTLSNP

SEQ ID NO: 54913 - protein, 160 aa, Homo sapiens
TPGLKQSSHLSLWSSWDYRLLDSLKRDYAGKPQPPIKSERRNPPSYAMAGKKVLIVYAHQEPKSFNGSLKNVAVDELSRQGCTVTVSDLYAMNLEPRATDKDITGTLSNPEVFNYGVETHEAYKQRSLASDITDEQKKVREADLVIFQMLSTELSLTSRC

SEQ ID NO: 54914 - protein, 76 aa, Homo sapiens
MAAAAASRGVGAKLGLREIRIHLCQRSPGSQGVRDFIEKRYVELKKANPDLPILIRECSDVQPKLWARYASRVQNS

SEQ ID NO: 54915 - protein, 70 aa, Homo sapiens
MWFEILPGLSVMGVCLLIPGLATAYIHRFTNGGKEKRVAHFGYHWSLMERDRRISGVDRYYVSKGLENID

SEQ ID NO: 54916 - protein, 355 aa, Homo sapiens
MALRLLKLAATSASARVVAAGAQRVRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 54917 - protein, 355 aa, Homo sapiens
MALRLLKLAATSASARVVARAPSAWRGIHSSVQCKLRYGMWHFLLGDKASKRLTERSRVITVDGNICTGKGKLAKEIAEKLGFKHFPEAGIHYPDSTTGDGKPLATDYNGNCSLEKFYDDPRSNDGNSYRLQSWLYSSRLLQYSDALEHLLTTGQGVVLERSIFSDFVFLEAMYNQGFIRKQCVDHYNEVKSVTICDYLPPHLVIYIDVPVPEVQRRIQKKGDPHEMKITSAYLQDIENAYKKTFLPEMSEKCEVLQYSAREAQDSKKVVEDIEYLKFDKGPWLKQDNRTLYHLRLLVQDKFEVLNYTSIPIFLPEVTIGAHQTDRVLHQFRELPGRKYSPGYNTEVGDKWIWLK

SEQ ID NO: 54918 - protein, 141 aa, Homo sapiens
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARTHNYGIGAAACVYFGIAASLVKMGRLEGWEVFAKPKV

SEQ ID NO: 54919 - protein, 228 aa, Homo sapiens
MAPKVFRQYWDIPDGTDCHRKAYSTTSIASVAGLTAAAYRVTLNPPGTFLEGVAKVGQYTFTAAAVGAVFGLTTCISAHVREKPDDPLNYFLGGCAGGLTLGARKTGSHCVVQAGLKLLASSSPHTSASQSAGIIGMSHCVQRFWVPSSSACLEVLSGESTDVHACSSTRGACNSSGSRPLPELGARASGSLRKGGHTHPAPRGAGALTPVQALIESLLNTLGSNPRT

SEQ ID NO: 54920 - protein, 227 aa, Homo sapiens
MQEPRRVTPCLGKRGVKTPQLQPGSAFLPRVRRQSFPARSDSYTTVRDFLAVPRTISSASATLIMAVAVSHFRPGPEVWDTASMAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 54921 - protein, 144 aa, Homo sapiens
MAASKVKQDMPPPGGYGPIDYKRNLPRRGLSGYSMLAIGIGTLIYGHWSIMKWNRERRRLQIEDFEARIALLPLLQAETDRRTLQMLRENLEEEAIIMKDVPDWKVGESVFHTTRWVPPLIGELYGLRTTEEALHASHGFMWYT

SEQ ID NO: 54922 - protein, 99 aa, Homo sapiens
MAAAAASRGVGAKLGLREIRIHLCQRSPGSQGVRDFIEKRYVELKKANPDLPILIRECSDVQPKLWARYAFGQETNVPLNNFSADQVTRALENVLSGKA

SEQ ID NO: 54923 - protein, 239 aa, Homo sapiens
MAGVLKKTTGLVGLAVCNTPHEVCTFVLSSFLNSQGRLNSCHFAYCRVNGIQMFQALNYKPRELLRHGRCPPTSLIRCHIFIYFCHDLFIKPVFLLTFSLTFSWLHLCLLLSAPSQIYISVFHLFSLPYRFCLGALDYIYLGLLKVLPPFPSVRSFPSVFTNVFIKKTHKFFILLVPSIITPFLCFTLQITQKSYLYFLQFLSYSPLNALSHPWRFSSSPIISMLPNPMVSSYFSPSLT

SEQ ID NO: 54924 - protein, 116 aa, Homo sapiens
MAGVLKKTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 54925 - protein, 116 aa, Homo sapiens
MPYRVGQTTGLVGLAVCNTPHERLRILYTKILDVLEEIPKNAAYRKYTEQITNEKLAMVKAEPDVKKLEDQLQGGQLEEVILQAEHELNLARKMREWKLWEPLVEEPPADQWKWPI

SEQ ID NO: 54926 - protein, 154 aa, Homo sapiens
MGKDIRPRSARAACKGVGLWSGCFGKMAGSGVRQATSTASTFVKPIFSRDMNEAKRRVRELYRAWYREVPNTVHQFQLDITVKMGRDKVREMFMKNAHVTDPRVVDLLVIKGKIELEETIKVWKQRTHVMRFFHETEAPRPKDFLSKFYVGHDP

SEQ ID NO: 54927 - protein, 113 aa, Homo sapiens
MASATRLIQRLRNWASGHDLQGKLQLRYQEISKRTQPPPKLPVGPSHKLSNNYYCTRDGRRESVPPSIIMSSQKALVSGKPAESSAVAATEKKAVTPAPPIKRWELSSDQPYL

SEQ ID NO: 54928 - protein, 172 aa, Homo sapiens
MPGIVELPTLEELKVDEVKISSAVLKAAAHHYGAQCDKPNKEFMLCRWEEKDPRRCLEEGKLVNKCALDFFRQIKRHCAEPFTEYWTCIDYTGQQLFRHCRKQQAKFDECVLDKLGWVRPDLGELSKVTKVKTDRPLPENPYHSRPRPDPSPEIEGDLQPATHGSRFYFWTK

SEQ ID NO: 54929 - protein, 128 aa, Homo sapiens
MPGIVELPTLEELKVDEVKISSAVLKAAAHHYGAQCDKPNKEFMLCRWEEKDPRRCLEEGKLVNKCALDFFRQIKRHCAEPFTEYWTCIDYTGQQLFRHCRKQQAKFDECVLDKLGWVRPDLGELSKG

SEQ ID NO: 54930 - protein, 377 aa, Homo sapiens
MAAAAQSRVVRVLSMSRSAITAIATSVCHGPPCRQLHHALMPHGKGGRSSVSGIVATVFGATGFLGRYVVNHLGRMGSQVIIPYRCDKYDIMHLRPMGDLGQLLFLEWDARDKDSIRRVVQHSNVVINLIGRDWETKNFDFEDVFVKIPQAIAQLSKEAGVEKFIHVSHLNANIKSSSRYLRNKAVGEKVVRDAFPEAIIVKPSDIFGREDRFLNSFASMHRFGPIPLGSLGWKTVKQPVYVVDVSKGIVNAVKDPDANGKSFAFVGPSRYLLFHLVKYIFAVAHRLFLPFPLPLFAYRWVARVFEISPFEPWITRDKVERMHITDMKLPHLPGLEDLGIQATPLELKAIEVLRRHRTYRWLSAEIEDVKPAKTVNI

SEQ ID NO: 54931 - protein, 327 aa, Homo sapiens
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPRGAFERKMSYDWSQFNTLYLRVRGDGRPWMVNIKEDTDFFQRTNQMYSYFMFTRGGPYWQEVKIPFSKFFFSNRGRIRDVQHELPLDKISSIGFTLADKVDGPFFLEIDFIGVFTDPAHTEEFAYENSPELNPRLFK

SEQ ID NO: 54932 - protein, 191 aa, Homo sapiens
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPR

SEQ ID NO: 54933 - protein, 209 aa, Homo sapiens
MALVHKLLRGTYFLRKFSKPTSALYPFLGIRFAEYSSSLQKPVASPGKASSQRKTEGDLQGDHQKEVALDITSSEEKPDVSFDKAIRDEAIYHFRLLKDEIVDHWRGPEGHPLHEVLLEQAKVVWQFRGKEDLDKWTVTSDKTIGGRSEVFLKMGKNNQSALLYGTLSSEAPQDGESTRSGYCAMISRIPRGAFERKMSYDWSQFNTLY

SEQ ID NO: 54934 - protein, 169 aa, Homo sapiens
MGWSQDLFRALWRSLSREVKEHVGTDQFGNKYYYIPQYKNWRGQTIREKRIVEAANKKEVDYEAGDIPTEWEAWIRRTRKTPPTMEEILKNEKHREEIKIKSQDFYEKEKLLSKETSEELLPPPVQTQIKGHASAPYFGKEEPSVAPSSTGKTFQPGSWMPRDGKSHNQ

SEQ ID NO: 54935 - protein, 127 aa, Homo sapiens
MYIDSYNSRGFMINGNRVLGPCALLPHSVVQWNVGSHQDITEDSFSLFWLLEPRIEIVVVGTGDRTERLQSQVLQAMRQRGIAVEVQDTPNACATFNFLCHEGRVTGAALIPPPGGTSLTSLGQAAQ

SEQ ID NO: 54936 - protein, 184 aa, Homo sapiens
MATALALRSLYRARPSLRCPPVELPWAPRRGHRLSPADDELYQRTRISLLQREAAQAMYIDSYNSRGFMINGNRVLGPCALLPHSVVQWNVGSHQDITEDSFSLFWLLEPRIEIVVVGTGDRTERLQSQVLQAMRQRGIAVEVQDTPNACATFNFLCHEGRVTGAALIPPPGGTSLTSLGQAAQ

SEQ ID NO: 54937 - protein, 127 aa, Homo sapiens; identical to SEQ ID NO: 54935

SEQ ID NO: 54938 - protein, 127 aa, Homo sapiens; identical to SEQ ID NO: 54935

SEQ ID NO: 54939 - protein, 175 aa, Homo sapiens
MGALVIRGIRNFNLENRAEREISKMKPSVAPRHPSTNSLLREQISLYPEVKGEIARKDEKLLSFLKDVYVDSKDPVSSLQVKAAETCQEPKEFRLPKDHHFDMINIKSIPKGKISIVEALTLLNNHKLFPETWTAEKIMQEYQLEQKDVNSLLKYFVTFEVEIFPPEDKKAIRSK

SEQ ID NO: 54940 - protein, 172 aa, Homo sapiens
MPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRYQDLGAYSSARKCLAKQRQRMLQERKAAKEAAAATS

SEQ ID NO: 54941 - protein, 168 aa, Homo sapiens
MPDSWDKDVYPEPPRRTPVQPNPIVYMMKAFDLIVDRPVTLVREFIERQHAKNRYYYYHRQYRRVPDITECKEEDIMCMYEAEMQWKRDYKVDQEIINIMQDRLKACQQREGQNYQQNCIKEVEQFTQVAKAYQDRCACPTHPQPPTILLRPGGQNHCKSSLPSLVLT

SEQ ID NO: 54942 - protein, 163 aa, Homo sapiens
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRCTGCPRAWDGMKEWSRREAERLVKYREANGLPIMESNCFDPSKIQLPEDE

SEQ ID NO: 54943 - protein, 153 aa, Homo sapiens
MAAGLFGLSARRLLAAAATRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRMKEWSRREAERLVKYREANGLPIMESNCFDPSKIQLPEDE

SEQ ID NO: 54944 - protein, 157 aa, Homo sapiens
AAPSVMAAGLFGLSARRLLAARRRGLPAARVRWESSFSRTVVAPSAVAGKRPPEPTTPWQEDPEPEDENLYEKNPDSHGYDKDPVLDVWNMRLVFFFGVSIILVLGSTFVAYLPDYRMKEWSRREAERLVKYREANGLPIMESNCFDPSKIQLPEDE

SEQ ID NO: 54945 - protein, 98 aa, Homo sapiens
MAHEHGHEHGHHKMELPDYRQWKIEGTPLETIQKKLAAKGLRDPWGRNEAWRYMGGFAKSVSFSDVFFKGFKWGFAAFVVAVGAEYYLESLNKDKKHH

SEQ ID NO: 54946 - protein, 98 aa, Homo sapiens; identical to SEQ ID NO: 54945

SEQ ID NO: 54947 - protein, 65 aa, Homo sapiens
MAHEHGHEHGHHKMELPDYRQWKIEGTPLETIQKKLAAKGLRDPWGRNEAWRYMGGFAKSVSFSD

SEQ ID NO: 54948 - protein, 98 aa, Homo sapiens; identical to SEQ ID NO: 54945

SEQ ID NO: 54949 - protein, 137 aa, Homo sapiens
MGAHLVRRYLGDASVEPDPLQMPTFPPDYGFPERKEREMVATQQEMMDAQLRLQLRDYCAHHLIRLLKCKRDSFPNFLACKQERHDWDYCEHRDYVMRMKEFERERRLLQRKKRREKKAAELAKGQGPGEVDPKVAL

SEQ ID NO: 54950 - protein, 186 aa, Homo sapiens
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVGPKQYPYNNLYLERGGDPSKEPERVVHYEI

SEQ ID NO: 54951 - protein, 172 aa, Homo sapiens
MAVARAGVLGVQWLQRASRNVMPLGARTASHMTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVCRHHFSYNLGFLSALG

SEQ ID NO: 54952 - protein, 155 aa, Homo sapiens
MTKDMFPGPYPRTPEERAAAAKKYNMRVEDYEPYPDDGMGYGDYPKLPDRSQHERDPWYSWDQPGLRLNWGEPMHWHLDMYNRNRVDTSPTPVSWHVMCMQLFGFLAFMIFMCWVGDVYPVYQPVGPKQYPYNNLYLERGGDPSKEPERVVHYEI

SEQ ID NO: 54953 - protein, 172 aa, Homo sapiens; identical to SEQ ID NO: 54951

SEQ ID NO: 54954 - protein, 179 aa, Homo sapiens
MAFLASGPYLTHQQKVLRLYKRALRHLESWCVQRDKYRYFACLMRARFEEHKNEKDMAKATQLLKEAEEEFWYRQHPQPYIFPDSPGGTSYERYDCYKVPEWCLDDWHPSEKAMYPDYFAKREQWKKLRRESWEREVKQLQEETPPGGPLTEALPPARKEGDLPPLWWYIVTRPRERPM

SEQ ID NO: 54955 - protein, 156 aa, Homo sapiens
MASRVLSAYVSRLPAAFAPLPRVRMLAVARPLSTALCSAGTQTRLGTLQPALVLAQVPGRVTQLCRQYSDMPPLTLEGIQDRVLYVLKLYDKIDPEKLSVNSHFMKDLGLDSLDQVEIIMAMEDEFGFEIPDIDAEKLMCPQEIVDYIADKKDVYE

SEQ ID NO: 54956 - protein, 76 aa, Homo sapiens
MAPSALLRPLSRLLAPARLPSGPSVRSKFYVREPPNAKPDWLKVGFTLGTTVFLWIYLIKQHNEDILEYKRRNGLE

SEQ ID NO: 54957 - protein, 76 aa, Homo sapiens; identical to SEQ ID NO: 54956

SEQ ID NO: 54958 - protein, 76 aa, Homo sapiens; identical to SEQ ID NO: 54956

SEQ ID NO: 54959 - protein, 76 aa, Homo sapiens; identical to SEQ ID NO: 54956

SEQ ID NO: 54960 - protein, 76 aa, Homo sapiens; identical to SEQ ID NO: 54956

SEQ ID NO: 54961 - protein, 76 aa, Homo sapiens; identical to SEQ ID NO: 54956

SEQ ID NO: 54962 - protein, 76 aa, Homo sapiens; identical to SEQ ID NO: 54956

SEQ ID NO: 54963 - protein, 76 aa, Homo sapiens; identical to SEQ ID NO: 54956

SEQ ID NO: 54964 - protein, 727 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 54965 - protein, 670 aa, Homo sapiens
MQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 54966 - protein, 616 aa, Homo sapiens
MWEGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 54967 - protein, 691 aa, Homo sapiens
MLRIPVRKALVGLSKSPKGCVRTTATAASNLIEVFVDGQSVMVEPGTTVLQVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 54968 - protein, 727 aa, Homo sapiens; identical to SEQ ID NO: 54964

SEQ ID NO: 54969 - protein, 130 aa, Homo sapiens
MLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPI

SEQ ID NO: 54970 - protein, 741 aa, Homo sapiens
MRIRGSSGTLSRINMLRIPVRKALVGLSKSPKGCVRTTATAASNLIEVFVDGQSVMVEPGTTVLQACEKVGMQIPRFCYHERLSVAGNCRMCLVEIEKAPKVVAACAMPVMKGWNILTNSEKSKKAREGVMEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 54971 - protein, 611 aa, Homo sapiens
MEFLLANHPLDCPICDQGGECDLQDQSMMFGNDRSRFLEGKRAVEDKNIGPLVKTIMTRCIQCTRCIRFASEIAGVDDLGTTGRGNDMQVGTYIEKMFMSELSGNIIDICPVGALTSKPYAFTARPWETRKTESIDVMDAVGSNIVVSTRTGEVMRILPRMHEDINEEWISDKTRFAYDGLKRQRLTEPMVRNEKGLLTYTSWEDALSRVAGMLQSFQGKDVAAIAGGLVDAEALVALKDLLNRVDSDTLCTEEVFPTAGAGTDLRSNYLLNTTIAGVEEADVVLLVGTNPRFEAPLFNARIRKSWLHNDLKVALIGSPVDLTYTYDHLGDSPKILQDIASGSHPFSQVLKEAKKPMVVLGSSALQRNDGAAILAAVSSIAQKIRMTSGVTGDWKVMNILHRIASQVAALDLGYKPGVEAIRKNPPKVLFLLGADGGCITRQDLPKDCFIIYQGHHGDVGAPIADVILPGAAYTEKSATYVNTEGRAQQTKVAVTPPGLAREDWKIIRALSEIAGMTLPYDTLDQVRNRLEEVSPNLVRYDDIEGANYFQQANELSKLVNQQLLADPLVPPQLTIKDFYMTDSISRASQTMAKCVKAVTEGAQAVEEPSIC

SEQ ID NO: 54972 - protein, 463 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTQDIVFGEVDR

SEQ ID NO: 54973 - protein, 457 aa, Homo sapiens
MAALRALCGFRGVAAQVLRPGAGVRLPIQPSRGVRQWQPDVEWAQQFGGAVMYPSKETAHWKPPPWNDVDPPKDTIVKNITLNFGPQHPAAHGVLRLVMELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDRYLCRVEEMRQSLRIIAQCLNKMPPGEIKVDDAKVSPPKRAEMKTSMESLIHHFKLYTEGYQVPPGATYTAIEAPKGEFGVYLVSDGSSRPYRCKIKAPGFAHLAGLDKMSKGHMLADVVAIIGTRPIV

SEQ ID NO: 54974 - protein, 231 aa, Homo sapiens
MELSGEMVRKCDPHIGLLHRGTEKLIEYKTYLQALPYFDRLDYVSMMCNEQAYSLAVEKLLNIRPPPRAQWIRVLFGEITRLLNHIMAVTTHALDLGAMTPFFWLFEEREKMFEFYERVSGARMHAAYIRPGGVHQDLPLGLMDDIYQFSKNFSLRLDELEELLTNNRIWRNRTIDIGVVTAEEALNYGFSGVMLRGSGIQWDLRKTQPYDVYDQVEFDVPVGSRGDCYDR

SEQ ID NO: 54975 - protein, 53 aa, Homo sapiens
MFEFYERVSGARMHAAYIRPGGVHQDLPLGLMDDIYQFSKNFSLRLDELEEVS

SEQ ID NO: 54976 - protein, 264 aa, Homo sapiens
MAAAAVARLWWRGILGASALTRGTGRPSVLLLPVRRESAGADTRPTVRPRNDVAHKQLSAFGEYVAEILPKYVQQVQVSCFNELEVCIHPDGVIPVLTFLRDHTNAQFKSLVDLTAVDVPTRQNRFEIVYNLLSLRFNSRIRVKTYTDELTPIESAVSVFKAANWYEREIWDMFGVFFANHPDLRRILTDYGFEGHPFRKDFPLSGYVELRYDDEVKRVVAEPVELAQEFRKFDLNSPWEAFPVYRQPPESLKLEAGDKKPDAK

SEQ ID NO: 54977 - protein, 175 aa, Homo sapiens
MAAVSMSVVLRQTLWRRRAVAVAALSVSRVPTRSLRTSTWRLAQDQTQDTQLITVDEKLDITTLTGVPEEHIKTRKVRIFVPARNNMQSGVNNTKKWKMEFDTRERWENPLMGWASTADPLSNMVLTFSTKEDAVSFAEKNGWSYDIEERKVPKPKSKSYGANFSWNKRTRVSTK

SEQ ID NO: 54978 - protein, 106 aa, Homo sapiens
MPFLDIQKRFGLNIDRWLTIQSGEQPYKMAGRCHAFEKEWIECAHGIGYTRAEKECKIEYDDFVECLLRQKTMRRAGTIRKQRDKLIKEGKYTPPPHHIGKGEPRP

SEQ ID NO: 54979 - protein, 106 aa, Homo sapiens; identical to SEQ ID NO: 54978

SEQ ID NO: 54980 - protein, 124 aa, Homo sapiens
MAAAMTFCRLLNRCGEAARSLPLGARCFGVRVSPTGEKVTHTGQVYDDKDYRRIRFVGRQKEVNENFAIDLIAEQPVSEVETRVIACDGGGGALGHPKVYINLDKETKTGTCGYCGLQFRQHHH

SEQ ID NO: 54981 - protein, 213 aa, Homo sapiens
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGCPPTAEALLYGILQLQRKIKRERRLQIWYRR

SEQ ID NO: 54982 - protein, 206 aa, Homo sapiens
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKVYDQMPEPRYVVSMGSCANGGGYYHYSYSVVRGCDRIVPVDIYIPGRAGTAPPTRELETGPAPHGARRPL

SEQ ID NO: 54983 - protein, 294 aa, Homo sapiens
MAVLSAPGLRGFRILGLRSSVGPAVQARGVHQSVATDGPSSTQPALPKARAVAPKPSSRGEYVVAKLDDLVNWARRVSTMSCRPSSSARASLHTHRHTHTHTNVQTRTHTTHACTLTCAHVHASSHVWTDVYTDHTHTHAHNAHMHTRTHAHLHTHAHTSTCAHTLAHIHTCTLALMHTHAHIYTCTRTLAHTCTYMHSHAHTCTLTHMHTRPCVDTCMCACWHACTQAHSLMHTHPCGRGAGRTLPEAPVLAWWPVVPSEDSDPAGDDPSVSVILFLASVCSSCFSFKVKAVF

SEQ ID NO: 54984 - protein, 214 aa, Homo sapiens
MAVLSAPGLRGFRILGLRSSVGPAVQARGVHQSVATDGPSSTQPALPKARAVAPKPSSRGEYVVAKLDDLVNWARRSSLWPMTFGLACCAVEMMHMAAPRYDMDRFGVVFRASPRQSDVMIVAGTLTNKMAPALRKSSLRPDAGAALRGLHGELRQRRRLLPLFLLGGEGLRPHRARGHLHPRLPTTAEALLYGILQLQRKIKRERRLQIWYRR

SEQ ID NO: 54985 - protein, 206 aa, Homo sapiens; identical to SEQ ID NO: 54982

SEQ ID NO: 54986 - protein, 210 aa, Homo sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYNKEKLLNNGDKWEAEIAANIQADYLYR

SEQ ID NO: 54987 - protein, 124 aa, Homo sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQ

SEQ ID NO: 54988 - protein, 110 aa, Homo sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEER

SEQ ID NO: 54989 - protein, 184 aa, Homo sapiens
MRCLTTPMLLRALAQAARAGPPGGRSLHSSAVAATYKYVNMQDPEMDMKSVTDRAARTLLWTELFRGLGMTLSYLFREPATINYPFEKGPLSPRFRGEHALRRYPSGEERCIACKLCEAICPAQAITIEAEPRADGSRRTTRYDIDMTKCIYCGFCQEACPVDAIVEGPNFEFSTETHEELLYN

SEQ ID NO: 54990 - protein, 64 aa, Homo sapiens
MTKCIYCGFCQEACPVDAIVEGPNFEFSTETHEELLYNKEKLLNNGDKWEAEIAANIQADYLYR

SEQ ID NO: 54991 - protein, 464 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 54992 - protein, 457 aa, Homo sapiens
MLATRRLLGWSLPARVSTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 54993 - protein, 335 aa, Homo sapiens
MLATRRLLGWSLPARVSVRFSGDTTAPKKTSFGSLKDEDRIFTNLYGRHDWRLKGSLSRGDWYKTKEILLKGPDWILGEIKTSGLRGRGGAGFPTGLKWSFMNKPSDGSPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 54994 - protein, 455 aa, Homo sapiens
MLATRRLLGWSLPARTAPKKTSFGSLKDEDRIFTNLYGRHDWRLKGSLSRGDWYKTKEILLKGPDWILGEIKTSGLRGRGGAGFPTGLKWSFMNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 54995 - protein, 363 aa, Homo sapiens
MNKPSDGRPKYLVVNADEGEPGTCKDREILRHDPHKLLEGCLVGGRAMGARAAYIYIRGEFYNEASNLQVAIREAYEAGLIGKNACGSGYDFDVFVVRGAGAYICGEETALIESIEGKQGKPRLKPPFPADVGVFGCPTTVANVETVAVSPTICRRGGTWFAGFGRERNSGTKLFNISGHVNHPCTVEEEMSVPLKELIEKHAGGVTGGWDNLLAVIPGGSSTPLIPKSVCETVLMDFDALVQAQTGLGTAAVIVMDRSTDIVKAIARLIEFYKHESCGQCTPCREGVDWMNKVMARFVRGDARPAEIDSLWEISKQIEGHTICALGDGAAWPVQGLIRHFRPELEERMQRFAQQHQARQAAS

SEQ ID NO: 54996 - protein, 249 aa, Homo sapiens
MFFSAALRARAAGLTAHWGRHVRNLHKTVMQNGAGGALFVHRDTPENNPDTPFDFTPENYKRIEAIVKNYPEGHKAAAVLPVLDLAQRQNGWLPISAMNKVAEVLQVPPMRVYEVATFYTMYNRKPVGKYHIQVCTTTPCMLRNSDSILEAIQKKLGIKVGETTPDKLFTLIEVECLGACVNAPMVQINDNYYEDLTAKDIEEIIDELKAGKIPKPGPRSGRFSCEPAGGLTSLTEPPKGPGFGVQAGL

SEQ ID NO: 54997 - protein, 108 aa, Homo sapiens
MAAPCLLRQGRAGALKTMLQEAQVFRGLASTVSLSAESGKSEKGQPQNSKKQSPPKKPAPVPAEPFDNTTYKNLQHHDYSTYTFLDLNLELSKFRMPQPSSGRESPRH

SEQ ID NO: 54998 - protein, 473 aa, Homo sapiens
MAAPCLLRQGRAGALKTMLQEAQVFRGLASTVSLSAESGKSEKGQPQNSKKQSPPKNVVEPKERGKLLATQTAAELSKNLSSPSSYPPAVNKGRKVASPSPSGSVLFTDEGVPKFLSRKTLVEFPQKVLSPFRKQGSDSEARQVGRKVTSPSSSSSSSSSDSESDDEADVSEVTPRVVSKGRGGLRKPEASHSFENRAPRVTVSAKEKTLLQKPHVDITDPEKPHQPKKKGSPAKPSEGRENARPKTTMPRSQVDEEFLKQSLKEKQLQKTFRLNEIDKESQKPFEVKGPLPVHTKSGLSAPPKGSPAPAVLAEEARAEGQLQASPPGAAEGHLEKPVPEPQRKAAPPLPRKETSGTQGIEGHLKGGQAIVEDQIPPSNLETVPVENNHGFHEKTAALKLEAEGEAMEDAAAPGDDRGGTQEPAPVPAEPFDNTTYKNLQHHDYSTYTFLDLNLELSKFRMPQPSSGRESPRH

SEQ ID NO: 54999 - protein, 112 aa, Homo sapiens
MLQEAQVFRGLASTVSLSAESGKSEKGQPQNSKKQSPPKSVPTPHRRYSPCGDWKDASSLKPAPVPAEPFDNTTYKNLQHHDYSTYTFLDLNLELSKFRMPQPSSGRESPRH

SEQ ID NO: 55000 - protein, 515 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 55001 - protein, 179 aa, Homo sapiens
MNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKSLRKCCHRYSSLDPRKVQFYFNKENF

SEQ ID NO: 55002 - protein, 527 aa, Homo sapiens
MGNWVVNHWFSVLFLVVWLGLNVFLFVDAFLKYEKADKYYYTRKILGFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 55003 - protein, 192 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIHPHITPTVYMFTVTFDMVLSSVNSNLFLFLLIKK

SEQ ID NO: 55004 - protein, 192 aa, Homo sapiens; identical to SEQ ID NO: 55003

SEQ ID NO: 55005 - protein, 564 aa, Homo sapiens
MGNWVVNHWFSVLFLVVWLGLNVFLFVDAFLKYEKADKYYYTRKILGSTLACARASALCLNFNSTLILLPVCRNLLSFLRGTCSFCSRTLRKQLDHNLTFHKLVAYMICLHTAIHIIAHLFNFDCYSRSRQATDGSLASILSSLSHDEKKGGSWLNPIQSRNTTVEYVTFTSIAGLTGVIMTIALILMVTSATEFIRRSYFEVFWYTHHLFIFYILGLGIHGIGGIVRGQTEESMNESHPRKCAESFEMWDDRDSHCRRPKFEGHPPESWKWILAPVILYICERILRFYRSQQKVVITKVVMHPSKVLELQMNKRGFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKVGFLNYRLFLTGWDSNIVGHAALNFDKATDIVTGLKQKTSFGRPMWDNEFSTIATSHPKSVVGVFLCGPRTLAKSLRKCCHRYSSLDPRKVQFYFNKENF

SEQ ID NO: 55006 - protein, 175 aa, Homo sapiens
  MOD_RES (1)..(1): Any amino acid
XFSMEVGQYIFVNCPSISLLEWHPFTLTSAPEEDFFSIHIRAAGDWTENLIRAFEQQYSPIPRIEVDGPFGTASEDVFQYEVAVLVGAGIGVTPFASILKSIWYKFQCADHNLKTKKIYFYWICRETGAFSWFNNLLTSLEQEMEELGKSLRKCCHRYSSLDPRKVQFYFNKENF

SEQ ID NO: 55007 - protein, 568 aa, Homo sapiens
MMGCWILNEGLSTILVLSWLGINFYLFIDTFYWYEEEESFHYTRVILGSTLAWARASALCLNFNCMLILIPVSRNLISFIRGTSICCRGPWRRQLDKNLRFHKLVAYGIAVNATIHIVAHFFNLERYHWSQSEEAQGLLAALSKLGNTPNESYLNPVRTFPTNTTTELLRTIAGVTGLVISLALVLIMTSSTEFIRQASYELFWYTHHVFIVFFLSLAIHGTGRIVRGQTQDSLSLHNITFCRDRYAEWQTVAQCPVPQFSGKEPSAWKWILGPVVLYACERIIRFWRFQQEVVITKVVSHPSGVLELHMKKRGFKMAPGQYILVQCPAISSLEWHPFTLTSAPQEDFFSVHIRAAGDWTAALLEAFGAEGQALQEPWSLPRLAVDGPFGTALTDVFHYPVCVCVAAGIGVTPFAALLKSIWYKCSEAQTPLKLSKVYFYWICRDARAFEWFADLLLSLETRMSEQGKTHFLSYHIFLTGWDENQALHIALHWDENTDVITGLKQKTFYGRPNWNNEFKQIAYNHPSSSIGVFFCGPKALSRTLQKMCHLYSSADPRGVHFYYNKESF

SEQ ID NO: 55008 - protein, 578 aa, Homo sapiens
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55009 - protein, 554 aa, Homo sapiens
MNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55010 - protein, 271 aa, Homo sapiens
MAVSWRSWLANEGVKHLCLFIWLSMNVLLFWKTFLLYNQGPEYHYLHQMLGCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55011 - protein, 54 aa, Homo sapiens
MAVSWRSWLANEGVKHLCLFIWLSMNVLLFWKTFLLYNQGPEYHYLHQMLGELS

SEQ ID NO: 55012 - protein, 599 aa, Homo sapiens
MGEMWRKREEVIFREYSFSFYPLNIFAPFVLFPDYFCLLGFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKLYIDGPFGSPFEESLNYEVSLCVAGGIGVTPFASILNTLLDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55013 - protein, 554 aa, Homo sapiens; identical to SEQ ID NO: 55009

SEQ ID NO: 55014 - protein, 554 aa, Homo sapiens; identical to SEQ ID NO: 55009

SEQ ID NO: 55015 - protein, 231 aa, Homo sapiens
MAVSWRSWLANEGVKHLCLFIWLSMNVLLFWKTFLLYNQGPEYHYLHQMLGCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55016 - protein, 538 aa, Homo sapiens
MAVSWRSWLANEGVKHLCLFIWLSMNVLLFWKTFLLYNQGPEYHYLHQMLGLGLCLSRASASVLNLNCSLILLPMCRTLLAYLRGSQKVPSRRTRRLLDKSRTFHITCGVTICIFSGVHVAAHLVNALNFSVNYSEDFVELNAARYRDEDPRKLLFTTVPGLTGVCMVVVLFLMITASTYAIRVSNYDIFWYTHNLFFVFYMLLTLHVSGGLLKYQTNLDTHPPGCISLNRTSSQNISLPEYFSEHFHEPFPEGFSKPAEFTQHKFVKICMEEPRFQANFPQTWLWISGPLCLYCAERLYRYIRSNKPVTIISVMSHPSDVMEIRMVKENFKARPGQYITLHCPSVSALENHPFTLTMCPTETKATFGVHLKIVGDWTERFRDLLLPPSSQDSEILPFIQSRNYPKDDWKPYKLRRLYFIWVCRDIQSFRWFADLLCMLHNKFWQENRPDYVNIQLYLSQTDGIQKIIGEKYHALNSRLFIGRPRWKLLFDEIAKYNRGKTVGVFCCGPNSLSKTLHKLSNQNNSYGTRFEYNKESFS

SEQ ID NO: 55017 - protein, 554 aa, Homo sapiens; identical to SEQ ID NO: 55009

SEQ ID NO: 55018 - protein, 554 aa, Homo sapiens; identical to SEQ ID NO: 55009

SEQ ID NO: 55019 - protein, 730 aa, Homo sapiens
MAFVCAGLSDTMSAEEDARWLRWVTQQFKTIAGEDGEISLQEFKAALHVKESFFAERFFALFDSDRSGTITLQELQEALTLLIHGSPMDKLKFLFQVYDIDGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55020 - protein, 765 aa, Homo sapiens
MNTSGDPAQTGPEGCRGTMSAEEDARWLRWVTQQFKTIAGEDGEISLQEFKAALHVKESFFAERFFALFDSDRSGTITLQELQEALTLLIHGSPMDKLKFLFQVYDIDVCARQGASAGTEWGAGAGPHWASSPLGTGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55021 - protein, 737 aa, Homo sapiens
MNTSGDPAQTGPEGCRGTMSAEEDARWLRWVTQQFKTIAGEDGEISLQEFKAALHVKESFFAERFFALFDSDRSGTITLQELQEALTLLIHGSPMDKLKFLFQVYDIDGSGSIDPDELRTVLQSCLRESAISLPDEKLDQLTLALFESADADGNGAITFEELRDELQRFPGVMENLTISAAHWLTAPAPRPRPRRPRQLTRAYWHNHRSQLFCLATYAGLHVLLFGLAASAHRDLGASVMVAKGCGQCLNFDCSFIAVLMLRRCLTWLRATWLAQVLPLDQNIQFHQLMGYVVVGLSLVHTVAHTVNFVLQAQAEASPFQFWELLLTTRPGIGWVHGSASPTGVALLLLLLLMFICSSSCIRRSGHFEVFYWTHLSYLLVWLLLIFHGPNFWKWLLVPGILFFLEKAIGLAVSRMAAVCIMEVNLLPSKVTHLLIKRPPFFHYRPGDYLYLNIPTIARYEWHPFTISSAPEQKDTIWLHIRSQGQWTNRLYESFKASDPLGRGSKRLSRSVTMRKSQRSSKGSEILLEKHKFCNIKCYIDGPYGTPTRRIFASEHAVLIGAGIGITPFASILQSIMYRHQKRKHTCPSCQHSWIEGVQDNMKLHKVDFIWINRDQRSFEWFVSLLTKLEMDQAEEAQYGRFLELHMYMTSALGKNDMKAIGLQMALDLLANKEKKDSITGLQTRTQPGRPDWSKVFQKVAAEKKGKVQVFFCGSPALAKVLKGHCEKFGFRFFQENF

SEQ ID NO: 55022 - protein, 1472 aa, Homo sapiens
MDNALFCLAAVSNLDIESKLSVYYRAPWHQQRNIFLPATRPPCVEELHRHARQSLQALRREHRSRSDRREQRAAAPLSIAAPPLPAYPPAHSQRRREFKDRHFLTFNSTRSPSPTECCHMTPWSRKSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 55023 - protein, 1630 aa, Homo sapiens
MPFAKRIVEPQWLCRQRRPAPGPAVDASGGSAEPPPPLQPPGRRDLDEVEAPGPEEPARAVPAPSGLPPPPPPLPAPADQTQPPHGEASVAGEESTAGIPEAAPAAGEASSAAAAAAVLLMLDLCAVSNAALARVLRQLSDVARHACSLFQELESDIQLTHRRVWALQGKLGGVQRVLSTLDPKQEAVPVSNLDIESKLSVYYRAPWHQQRNIFLPATRPPCVEELHRHARQSLQALRREHRSRSDRREQRAAAPLSIAAPPLPAYPPAHSQRRREFKDRHFLTSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 55024 - protein, 1474 aa, Homo sapiens
MALACCMPKNAAVSNLDIESKLSVYYRAPWHQQRNIFLPATRPPCVEELHRHARQSLQALRREHRSRSDRREQRAAAPLSIAAPPLPAYPPAHSQRRREFKDRHFLTFNSTRSPSPTECCHMTPWSRKSHPPEDEDTDVMLGQRPKNPIHNIPSTLDKQTNWSKALPLPTPEEKMKQDAQVISSCIIPINVTGVGFDREASIRCSLVHSQSVLQRRRKLRRRKTISGIPRRVQQEIDSDESPVARERNVIVHTNPDPSNTVNRISGTRDSECQTEDILIAAPSRRRIRAQRGQSIAASLSHSAGNISALADKGDTMFTPAVSSRTRSRSLPREGNRGGDAEPKVGAKPSAYEEGESFVGDHERTPNDFSEAPSSPSAQDHQPTLGLACSQHLHSPQHKLSERGRSRLSRMAADSGSCDISSNSDTFGSPIHCISTAGVLLSSHMDQKDDHQSSSGNWSGSSSTCPSQTSETIPPAASPPLTGSSHCDSELSLNTAPHANEDASVFVTEQYNDHLDKVRGHRANSFTSTVADLLDDPNNSNTSDSEWNYLHHHHDASCRQDFSPERPKADSLGCPSFTSMATYDSFLEKSPSDKADTSSHFSVDTEGYYTSMHFDCGLKGNKSYVCHYAALGPENGQGVGASPGLPDCAWQDYLDHKRQGRPSISFRKPKAKPTPPKRSSSLRKSDGNADISEKKEPKISSGQHLPHSSREMKLPLDFANTPSRMENANLPTKQEPSWINQSEQGIKEPQLDASDIPPFKDEVAESTHYADLWLLNDLKTNDPYRSLSNSSTATGTTVIECIKSPESSESQTSQSESRATTPSLPSVDNEFKLASPEKLAGLASPSSGYSSQSETPTSSFPTAFFSGPLSPGGSKRKPKVPERKSSLQQPSLKDGTISLSKDLELPIIPPTHLDLSALHNVLNKPFHHRHPLHVFTHNKQNTVGETLRSNPPPSLAITPTILKSVNLRSINKSEEVKQKEENNTDLPYLEESTLTTAALSPSKIRPHTANKSVSRQYSTEDTILSFLDSSAVEMGPDKLHLEKNSTFDVKNRCDPETITSAGSSLLDSNVTKDQVRTETEPIPENTPTKNCAFPTEGFQRVSAARPNDLDGKIIQYGPGPDETLEQVQKAPSAGLEEVAQPESVDVITSQSDSPTRATDVSNQFKHQFVMSRHHDKVPGTISYESEITSVNSFPEKCSKQENIASGISAKSASDNSKAEETQGNVDEASLKESSPSDDSIISPLSEDSQAEAEGVFVSPNKPRTTEDLFAVIHRSKRKVLGRKDSGDMSVRSKSRAPLSSSSSSASSITSPSSNVTTPNSQRSPGLIYRNAKKSNTSNEEFKLLLLKKGSRSDSSYRMSATEILKSPILPKPPGELTAESPQSTDDAHQGSQGAEALSPLSPCSPRVNAEGFSSKSFATSASARVGRSRAPPAASSSRYSVRCRLYNTPMQAISEGETENSDGSPHDDRSSQSST

SEQ ID NO: 55025 - protein, 84 aa, Homo sapiens
PELQVCVFCRNNKEAMALYTTHILKGPDGRVLCPVLRRYTCPLCGASGDNAHTIKYCPLSKVPPPPARPPPRSARDGPPGKKLR

SEQ ID NO: 55026 - protein, 292 aa, Homo sapiens
MEAFPWAPRSPRRGRAPPPMALVPSARYVSAPGPAHPQPFSSWNDYLGLATLITKAVDGEPRFGCARGGNGGGGSPPSSSSSSCCSPHTGAGPGALGPALGPPDYDEDDDDDSDEPGSRGRYLGSALELRALELCAGPAEAGLLEERFAELSPFAGRAAAVLLGCAPAAAAAATTTSEATPREERAPAWAAEPRLHAASGAAAARLLKPELQVCVFCRNNKEAMALYTTHILKGPDGRVLCPVLRRYTCPLCGASGDNAHTIKYCPLSKVPPPPARPPPRSARDGPPGKKLR

SEQ ID NO: 55027 - protein, 1151 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55028 - protein, 1219 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55029 - protein, 553 aa, Homo sapiens
MLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55030 - protein, 538 aa, Homo sapiens
  MOD_RES (1)..(1): Any amino acid
XKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55031 - protein, 1087 aa, Homo sapiens
MEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESRSAPVQHLAGWQAEEQQGETDTVLSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLADCIIPITDIRAFTTTLNLLPYHKIVK

SEQ ID NO: 55032 - protein, 747 aa, Homo sapiens
MEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTVLCQWAQDSET

SEQ ID NO: 55033 - protein, 1148 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQSAAALCVGVGSFADPDDLPGLAHFLEHMVFMGSLKYPDENGFDAFLKKHGGSDNASTDCERTVFQFDVQRKYFKEALDRWAQFFIHPLMIRDAIDREVEAVDSEYQLARPSDANRKEMLFGSLARPGHPMGKFFWGNAETLKHEPRKNNIDTHARLREFWMRYYSSHYMTLVVQSKETLDTLEKWVTEIFSQIPNNGLPRPNFGHLTDPFDTPAFNKLYRVVPIRKIHALTITWALPPQQQHYRVKPLHYISWLVGHEGKGSILSFLRKKCWALALFGGNGETGFEQNSTYSVFSISITLTDEGYEHFYEVAYTVFQYLKMLQKLGPEKRIFEEIRKIEDNEFHYQEQTDPVEYVENMCENMQLYPLQDILTGDQLLFEYKPEVIGEALNQLVPQKANLVLLSGANEGKCDLKEKWFGTQYSIEDIENSWAELWNSNFELNPDLHLPAENKYIATDFTLKAFDCPETEYPVKIVNTPQGCLWYKKDNKFKIPKAYIRFHLISPLIQKSAANVVLFDIFVNILTHNLAEPAYEADVAQLEYKLVAGEHGLIIRVKGFNHKLPLLFQLIIDYLAEFNSTPAVFTMITEQLKKTYFNILIKPETLAKDVRLLILEYARWSMIDKYQALMDGLSLESLLSFVKEFKSQLFVEGLVQGNVTSTESMDFLKYVVDKLNFKPLEQEMPVQFQVVELPSGHHLCKVKALNKGDANSEVTVYYQSGTRSLREYTLMELLVMHMEEPCFDFLRTKQTLGYHVYPTCRNTSGILGFSVTVGTQATKYNSEVVDKKIEEFLSSFEEKIENLTEEAFNTQVTALIKLKECEDTHLGEEVDRNWNEVVTQQYLFDRLAHEIEALKSFSKSDLVNWFKAHRGPGSKMLSVHVVGYGKYELEEDGTPSSEDSNSSCEVMQLTYLPTSPLLAIVSSPLLISGLSQQHSTFSPTIK

SEQ ID NO: 55034 - protein, 528 aa, Homo sapiens
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAVFRGYAERKRRKRENDSASVIQRNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55035 - protein, 327 aa, Homo sapiens
MYSVDRVSDDIPIRTWFPKENLFSFQTATTTMQAVFRGYAERKRRKRENDSASVIQRNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55036 - protein, 145 aa, Homo sapiens
MVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYVSPAPGLPPTDALLRPHPGPAPAPQVPRVLWRCWL

SEQ ID NO: 55037 - protein, 528 aa, Homo sapiens; identical to SEQ ID NO: 55034

SEQ ID NO: 55038 - protein, 500 aa, Homo sapiens
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISVFRGYAERKRRKRENDSASVIQRNFRKHLRMVGSRRVKAQSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55039 - protein, 505 aa, Homo sapiens
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQANFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55040 - protein, 530 aa, Homo sapiens
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISVFRGYAERKRRKRENDSASVIQRNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55041 - protein, 194 aa, Homo sapiens
MGLGPLSSSLSPQLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55042 - protein, 507 aa, Homo sapiens
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAVGNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55043 - protein, 507 aa, Homo sapiens
MGAAASRRRALRSEAMSSVAAKVRAARAFGEYLSQSHPENRNGADHLLADAYSGHDGSPEMQPAPQNKRRLSLVSNGCYEGSLSEEPSIRKPAGEGPQPRVYTISGEPALLPSPEAEAIELAVVKGRRQRHPHHHSQPLRASPGGSREDVSRPCQSWAGSRQGSKECPGCAQLAPGPTPRAFGLDQPPLPETSGRRKKLERMYSVDRVSDDIPIRTWFPKENLFSFQTATTTMQAISNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55044 - protein, 327 aa, Homo sapiens
MQLGRRLDPERQALHLCSGVEGEPWKAVAGRALGGICLWVGGGARSQGEHWLPTPKGNFRKHLRMVGSRRVKAQTFAERRERSFSRSWSDPTPMKADTSHDSRDSSDLQSSHCTLDEAFEDLDWDTEKGLEAVACDTEGFVPPKVMLISSKVPKAEYIPTIIRRDDPSIIPILYDHEHATFEDILEEIERKLNVYHKGAKIWKMLIFCQGGPGHLYLLKNKVATFAKVEKEEDMIHFWKRLSRLMSKVNPEPNVIHIMGCYILGNPNGEKLFQNLRTLMTPYRVTFESPLELSAQGKQMIETYFDFRLYRLWKSRQHSKLLDFDDVL

SEQ ID NO: 55045 - protein, 215 aa, Homo sapiens
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55046 - protein, 215 aa, Homo sapiens; identical to SEQ ID NO: 55045

SEQ ID NO: 55047 - protein, 2078 aa, Homo sapiens
MPGEATETVPATEQELPQPQAETAVLPMSSALSVTAALGQPGPTLPPPCSPAPQQCPLSAANQASPFPSPSTIASTPLEVPFPQSSSGTALPLGTAPEAPTFLPNLIGPPISPAALALASPMIAPTLKGTPSSSAPLALVALAPHSVQKSSAFPPNLLTSPPSVAVAESGSVITLSAPIAPSEPKTNLNKVPSEVVPNPKGTPSPPCIVSTVPYHCVTPMASIQSGVASLPQTTPTTTLAIASPQVKDTTISSVLISPQNPGSLSLKGPVSPPAALSLSTQSLPVVTSSQKTAGPNTPPDFPISLGSHLAPLHQSSFGSVQLLGQTGPSALSDPTVKTISVDHSSTGASYPSQRSVIPPLPSRNEVVPATVAAFPVVAPSVDKGPSTISSITCSPSGSLNVATSFSLSPTTSLILKSSPNATYHYPLVAQMPVSSVGTTPLVVTNPCTIAAAPTTTFEVATCVSPPMSSGPISNIEPTSPAALVMAPVAPKEPSTQVATTLRIPVSPPLPDPEDLKNLPSSVLVKFPTQKDLQTVPASLEGAPFSPAQAGLTTKKDPTVLPLVQAAPKNSPSFQSTSSSPEIPLSPEATLAKKSLGEPLPIGKPASSMTSPLGVNSSASVIKTDSYAGPDSAGPLLKSSLITPTVAAFPLESADPAGVAPTTAKGTSTYTTTASPFLEGTVSLAPKNHPVKEGTLTTLPLVPTASENCPVAPSPQNTCAPLATLVLAPEIPKSVPSPSLPPAGTPPGTKKVDGISHTSALAPVASSPKECPTEDSGASATASSKGTLTYLADSPSPLGVSVSPQTKRPPTKKGSAGPDTPIGNLSSPVSPVEASFLPENSLSFQGSKDSPATTHSPTPPSPKGAPTPSAVTPLSPKGVTLPPKETPTPSVVNLPFPKEGPATPAPKQAPALSMTSSSPKKARATPAPKGIPASPSPKGAPTPPAATPPSPKGGPATPSPKWAPTPPAATPPSPKGGPATPSPKGAPTPPAATPPSPKGGPATPSPKGAPTPPAVTPPSPKGSPAATPFPKGASTPPAATPPSPKGSPAATPLPKGAPTTPAATLPSPKGGPATPSLKGAPTPPAATPPSPKGGPATPSPKGAPMPPAATPPSPKGGLATPPHKGAPTTPAATPPSPKGGLATPPPKGAPTTPAATPPSPKGGLATPPPKGAPTTPAATPPSPKGGLATPSPKGAPTTPAATPPSPKGGLATPSPKGAPTTPAATPPSPKGGLATPSPKGAPTTPAATPPSPKGGPATPPPKGAPTPPAATPPSLKGGLATPPHKGAPNPAVVTPPSPKGGPATSPPKGAPTPPAATPPSPKGSPGTPPPKGAPTPPAVTPPSPKGTPTLPATTPSSKGGPTTPSSKEGPTPPAATPSHKGGPAMTPPSPKRGPAIPSPKGDPTSPAVIPLSPKKAPATPVTREGAATPSKGDLTPPAVTPVSLKKAPATSAPKGGPATPSSKGDPTLPAVTPPSPKEPPAPKQVATSSSPKKAPATPAPMGAPTLPAVIPSSPKEVPATPSSRRDPIAPTATLLSKKTPATLAPKEALIPPAMTVPSPKKTPAIPTPKEAPATPSSKEASSPPAVTPSTYKGAPSPKELLIPPAVTSPSPKEAPTPPAVTPPSPEKGPATPAPKGTPTSPPVTPSSLKDSPTSPASVTCKMGATVPQASKGLPAKKGPTALKEVLVAPAPESTPIITAPTRKGPQTKKSSATSPPICPDPSAKNGSKGPLSTVAPAPLLPVQKDSSKTAKGKDASHSPKGPLAPPESKASTPLTAAAFEKVLPKPESASVSAAPSPPVSLPLAPSPVPTLPPKQQFLPSSPGLVLESPSKPLAPADEDELLPLIPPEPISGGVPFQSVLVNMPTPKSAGIPVPTPSAKQPVTKNNKGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55048 - protein, 215 aa, Homo sapiens; identical to SEQ ID NO: 55045

SEQ ID NO: 55049 - protein, 6 aa, Homo sapiens
MPGEAT

SEQ ID NO: 55050 - protein, 198 aa, Homo sapiens
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRA

SEQ ID NO: 55051 - protein, 126 aa, Homo sapiens
MPGEATETVPATEQELPQPQAETGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEA

SEQ ID NO: 55052 - protein, 215 aa, Homo sapiens; identical to SEQ ID NO: 55045

SEQ ID NO: 55053 - protein, 925 aa, Homo sapiens
MPGEATETVPATEQELPQPQAETAVLPMSSALSVTAALGQPGPTLPPPCSPAPQQCPLSAANQASPFPSPSTIASTPLEVPFPQSSSGTALPLGTAPEAPTFLPNLIGPPISPAALALASPMIAPTLKGTPSSSAPLALVALAPHSVQKSSAFPPNLLTSPPSVAVAESGSVITLSAPIAPSEPKTNLNKVPSEVVPNPKGTPSPPCIVSTVPYHCVTPMASIQSGVASLPQTTPTTTLAIASPQVKDTTISSVLISPQNPGSLSLKGPVSPPAALSLSTQSLPVVTSSQKTAGPNTPPDFPISLGSHLAPLHQSSFGSVQLLGQTGPSALSDPTVKTISVDHSSTGASYPSQRSVIPPLPSRNEVVPATVAAFPVVAPSVDKGPSTISSITCSPSGSLNVATSFSLSPTTSLILKSSPNATYHYPLVAQMPVSSVGTTPLVVTNPCTIAAAPTTTFEVATCVSPPMSSGPISNIEPTSPAALVMAPVAPKEPSTQVATTLRIPVSPPLPDPEDLKNLPSSVLVKFPTQKDLQTVPASLEGAPFSPAQAGLTTKKDPTVLPLVQAAPKNSPSFQSTSSSPEIPLSPEATLAKKSLGEPLPIVAAFPLESADPAGVAPTTAKAAAFEKVLPKPESASVSAAPSPPVSLPLAPSPVPTLPPKQQFLPSSPGLVLESPSKPLAPADEDELLPLIPPEPISGGVPFQSVLVNMPTPKSAGIPVPTPSAKQPVTKNNKGSGTESDSDESVPELEEQDSTQATTQQAQLAAAAEIDEEPVSKAKQSRSEKKARKAMSKLGLRQVTGVTRVTIRKSKNILFVITKPDVYKSPASDTYIVFGEAKIEDLSQQAQLAAAEKFKVQGEAVSNIQENTQTPTVQEESEEEEVDETGVEVKDIELVMSQANVSRAKAVRALKNNSNDIVNAIMELTM

SEQ ID NO: 55054 - protein, 101 aa, Homo sapiens
MPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 55055 - protein, 151 aa, Homo sapiens
MSSFSTTTVSFLLLLAFQLLGQTRANPMYNAVSNADLMDFKNLLDHLEEKMPLEDEVVPPQVLSEPNEEAGAALSPLPEVPPWTGEVSPAQRDGGALGRGPWDSSDRSALLKSKLRALLTAPRSLRRSSCFGGRMDRIGAQSGLGCNSFRY

SEQ ID NO: 55056 - protein, 255 aa, Homo sapiens
MEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKVEGEASALPTFWGPRGSYPSQAANATPIPKALI

SEQ ID NO: 55057 - protein, 1061 aa, Homo sapiens
MPGPRRPAGSRLRLLLLLLLPPLLLLLRGSHAGNLTVAVVLPLANTSYPWSWARVGPAVELALAQVKARPDLLPGWTVRTVLGSSENALGVCSDTAAPLAAVDLKWEHNPAVFLGPGCVYAAAPVGRFTAHWRVPLLTAGAPALGFGVKDEYALTTRAGPSYAKLGDFVAALHRRLGWERQALMLYAYRPGDEEHCFFLVEGLFMRVRDRLNITVDHLEFAEDDLSHYTRLLRTMPRKGRVIYICSSPDAFRTLMLLALEAGLCGEDYVFFHLDIFGQSLQGGQGPAPRRPWERGDGQDVSARQAFQAAKIITYKDPDNPEYLEFLKQLKHLAYEQFNFTMEDGLVNTIPASFHDGLLLYIQAVTETLAHGGTVTDGENITQRMWNRSFQGVTGYLKIDSSGDRETDFSLWDMDPENGAFRVVLNYNGTSQELVAVSGRKLNWPLGYPPPDIPKCGFDNEDPACNQDHLSTLEVLALVGSLSLLGILIVSFFIYRKMQLEKELASELWRVRWEDVEPSSLERHLRSAGSRLTLSGRGSNYGSLLTTEGQFQVFAKTAYYKGNLVAVKRVNRKRIELTRKVLFELKHMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 55058 - protein, 540 aa, Homo sapiens
KMQLEKELASELWRVRWEDVEPSSLERHLRSAGSRLTLSGRGSNYGSLLTTEGQFQVFAKTAYYKMRDVQNEHLTRFVGACTDPPNICILTEYCPRGSLQDILENESITLDWMFRYSLTNDIVKGMLFLHNGAICSHGNLKSSNCVVDGRFVLKITDYGLESFRDLDPEQGHTVYAKKLWTAPELLRMASPPVRGSQAGDVYSFGIILQEIALRSGVFHVEGLDLSPKEIIERVTRGEQPPFRPSLALQSHLEELGLLMQRCWAEDPQERPPFQQIRLTLRKFNRENSSNILDNLLSRMEQYANNLEELVEERTQAYLEEKRKAEALLYQILPHSVAEQLKRGETVQAEAFDSVTIYFSDIVGFTALSAESTPMQVVTLLNDLYTCFDAVIDNFDVYKVETIGDAYMVVSGLPVRNGRLHACEVARMALALLDAVRSFRIRHRPQEQLRLRIGIHTGPVCAGVVGLKMPRYCLFGDTVNTASRMESNGEALKIHLSSETKAVLEEFGGFELELRGDVEMKGKGKVRTYWLLGERGSSTRG

SEQ ID NO: 55059 - protein, 1047 aa, Homo sapiens
MALPSLLLLVAALAGGVRPPGARNLTLAVVLPEHNLSYAWAWPRVGPAVALAVEALGRALPVDLRFVSSELEGACSEYLAPLSAVDLKLYHDPDLLLGPGCVYPAASVARFASHWRLPLLTAGAVASGFSAKNDHYRTLVRTGPSAPKLGEFVVTLHGHFNWTARAALLYLDARTDDRPHYFTIEGVFEALQGSNLSVQHQVYAREPGGPEQATHFIRANGRIVYICGPLEMLHEILLQAQRENLTNGDYVFFYLDVFGESLRAGPTRATGRPWQDNRTREQAQALREAFQTVLVITYREPPNPEYQEFQNRLLIRAREDFGVELGPSLMNLIAGCFYDGILLYAEVLNETIQEGGTREDGLRIVEKMQGRRYHGVTGLVVMDKNNDRETDFVLWAMGDLDSGDFQPAAHYSGAEKQIWWTGRPIPWVKGAPPSDNPPCAFDLDDPSCDKTPLSTLAIVALGTGITFIMFGVSSFLIFRKLMLEKELASMLWRIRWEELQFGNSERYHKGAGSRLTLSLRGSSYGSLMTAHGKYQIFANTGHFKGNVVAIKHVNKKRIELTRQVLFELKHMRDVQFNHLTRFIGACIDPPNICIVTEYCPRGSLQDILENDSINLDWMFRYSLINDLVKGMAFLHNSIISSHGSLKSSNCVVDSRFVLKITDYGLASFRSTAEPDDSHALYAKKLWTAPELLSGNPLPTTGMQKADVYSFGIILQEIALRSGPFYLEGLDLSPKEIVQKVRNGQRPYFRPSIDRTQLNEELVLLMERCWAQDPAERPDFGQIKGFIRRFNKEGGTSILDNLLLRMEQYANNLEKLVEERTQAYLEEKRKAEALLYQILPHSVAEQLKRGETVQAEAFDSVTIYFSDIVGFTALSAESTPMQVVTLLNDLYTCFDAIIDNFDVYKVETIGDAYMVVSGLPGRNGQRHAPEIARMALALLDAVSSFRIRHRPHDQLRLRIGVHTGPVCAGVVGLKMPRYCLFGDTVNTASRMESNGQALKIHVSSTTKDALDELGCFQLELRGDVEMKGKGKMRTYWLLGERKGPPGLL

SEQ ID NO: 55060 - protein, 541 aa, Homo sapiens
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSSGGLEESAVTGIVVGALLGAGLLMAFYFFRKKYRITIERRTQQEESNLGKHRELREDSIRSHFSVA

SEQ ID NO: 55061 - protein, 540 aa, Homo sapiens
MPSLLVLTFSPCVLLGWALLAGGTGGGGVGGGGGGAGIGGGRQEREALPPQKIEVLVLLPQDDSYLFSLTRVRPAIEYALRSVEGNGTGRRLLPPGTRFQVAYEDSDCGNRALFSLVDRVAAARGAKPDLILGPVCEYAAAPVARLASHWDLPMLSAGALAAGFQHKDSEYSHLTRVAPAYAKMGEMMLALFRHHHWSRAALVYSDDKLERNCYFTLEGVHEVFQEEGLHTSIYSFDETKDLDLEDIVRNIQASERVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSCGLEESAVTGIVVGALLGAGLLMAFYFFRKKYRITIERRTQQEESNLGKHRELREDSIRSHFSVA

SEQ ID NO: 55062 - protein, 324 aa, Homo sapiens
MEPSALGPWSLFPDLAPRDQEGQVLAPRRCFRRECGQNEKVVIMCASSDTIRSIMLVAHRHGMTSGDYAFFNIELFNSSSYGDGSWKRGDKHDFEAKQAYSSLQTVTLLRTVKPEFEKFSMEVKSSVEKQGLNMEDYVNMFVEGFHDAILLYVLALHEVLRAGYSKKDGGKIIQQTWNRTFEGIAGQVSIDANGDRYGDFSVIAMTDVEAGTQEVIGDYFGKEGRFEMRPNVKYPWGPLKLRIDENRIVEHTNSSPCKSCGLEESAVTGIVVGALLGAGLLMAFYFFRKKYRITIERRTQQEESNLGKHRELREDSIRSHFSVA

SEQ ID NO: 55063 - protein, 304 aa, Homo sapiens
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55064 - protein, 287 aa, Homo sapiens
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDHALWDHTAQNLLRMGLAFLVLVALVWFLVEDWLSRKRTRERASRASTWEGRRRLNTQTL

SEQ ID NO: 55065 - protein, 209 aa, Homo sapiens
MSSTLPALLCVGLCLSQRISAQQQMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55066 - protein, 197 aa, Homo sapiens
MSSTLPALLCVEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPADTWGTYLLTTETGLQKDHALWDHTAQNLLRMGLAFLVLVALVWFLVEDWLSRKRTRERASRASTWEGRRRLNTQTL

SEQ ID NO: 55067 - protein, 303 aa, Homo sapiens
MSSTLPALLCVGLCLSQRISAQQQTLPKPFIWAEPHFMVPKEKQVTICCQGNYGAVEYQLHFEGSLFAVDRPKPPERINKVKFYIPDMNSRMAGQYSCIYRVGELWSEPSNLLDLVVTEMYDTPTLSVHPGPEVISGEKVTFYCRLDTATSMFLLLKEGRSSHVQRGYGKVQAEFPLGPVTTAHRGTYRCFGSYNNHAWSFPSEPVKLLVTGDIENTSLAPEDPTFPDTWGTYLLTTETGLQKDHALWDHTAQNLLRMGLAFLVLVALVWFLVEDWLSRKRTRERASRASTWEGRRRLNTQTL

SEQ ID NO: 55068 - protein, 258 aa, Homo sapiens
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIALVPVFCGLLVAKSLVLSALLVWWVLRNRHMQHQGRSLLHPAQPRPQAHRHFPLSHRAPGGTYGGKP

SEQ ID NO: 55069 - protein, 270 aa, Homo sapiens
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSHPSSPLPVPLPSRPQNSTLRPGPAAPIALVPVFCGLLVAKSLVLSALLVWWVLRNRHMQHQGRSLLHPAQPRPQAHRHFPLSHRAPGGTYGGKP

SEQ ID NO: 55070 - protein, 276 aa, Homo sapiens
MAWRALHPLLLLLLLFPGSQAQSKAQVLQSVAGQTLTVRCQYPPTGSLYEKKGWCKEASALVCIRLVTSSKPRTMAWTSRFTIWDDPDAGFFTVTMTDLREEDSGHYWCRIYRPSDNSVSKSVRFYLVVSPASASTQTSWTPRDLVSSQTQTQSCVPPTAGARQAPESPSTIPVPSQPQNSTLRPGPAAPIALVPVFCGLLVAKSLVLSALLVWWGDIWWKTMMELRSLDTQKATCHLQQVTDLPWTSVSSPVEREILYHTVARTKISDDDDEHTL

SEQ ID NO: 55071 - protein, 201 aa, Homo sapiens
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCLTWKGPRRQLPAVVPAPLPPPCGSSAHLLPPVPGG

SEQ ID NO: 55072 - protein, 165 aa, Homo sapiens
MAWMLLLILIMVHPGSCALWVSQPPEIRTLEGSSAFLPCSFNASQGRLAIGSVTWFRDEVVPGKEAELHIRDVRGHDASIYVCRVEVLGLGVGTGNGTRLVVEKEHPQLGAGTVLLLRAGFYAVSFLSVAVGSTVYYQGKCHCHMGTHCHSSDGPRGVIPEPRCP

SEQ ID NO: 55073 - protein, 190 aa, Homo sapiens
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKCHCHMGTHCHSSDGPRGVIPEPRCP

SEQ ID NO: 55074 - protein, 177 aa, Homo sapiens
MAWMLLLILIMVHPGSCALWVSQPPEIRTLEGSSAFLPCSFNASQGRLAIGSVTWFRDEVVPGKEVRNGTPEFRGRLAPLASSRFLHDHQAELHIRDVRGHDASIYVCRVEVLGLGVGTGNGTRLVVEKEHPQLGAGTVLLLRAGFYAVSFLSVAVGSTVYYQGKYAKSTLSGFPQL

SEQ ID NO: 55075 - protein, 190 aa, Homo sapiens; identical to SEQ ID NO: 55073

SEQ ID NO: 55076 - protein, 201 aa, Homo sapiens; identical to SEQ ID NO: 55071

SEQ ID NO: 55077 - protein, 177 aa, Homo sapiens; identical to SEQ ID NO: 55074

SEQ ID NO: 55078 - protein, 165 aa, Homo sapiens; identical to SEQ ID NO: 55072

SEQ ID NO: 55079 - protein, 190 aa, Homo sapiens; identical to SEQ ID NO: 55073

SEQ ID NO: 55080 - protein, 201 aa, Homo sapiens; identical to SEQ ID NO: 55071

SEQ ID NO: 55081 - protein, 190 aa, Homo sapiens; identical to SEQ ID NO: 55073

SEQ ID NO: 55082 - protein, 165 aa, Homo sapiens; identical to SEQ ID NO: 55072

SEQ ID NO: 55083 - protein, 165 aa, Homo sapiens; identical to SEQ ID NO: 55072

SEQ ID NO: 55084 - protein, 165 aa, Homo sapiens; identical to SEQ ID NO: 55072

SEQ ID NO: 55085 - protein, 201 aa, Homo sapiens; identical to SEQ ID NO: 55071

SEQ ID NO: 55086 - protein, 201 aa, Homo sapiens; identical to SEQ ID NO: 55071

SEQ ID NO: 55087 - protein, 177 aa, Homo sapiens; identical to SEQ ID NO: 55074

SEQ ID NO: 55088 - protein, 177 aa, Homo sapiens; identical to SEQ ID NO: 55074

SEQ ID NO: 55089 - protein, 201 aa, Homo sapiens; identical to SEQ ID NO: 55071

SEQ ID NO: 55090 - protein, 177 aa, Homo sapiens; identical to SEQ ID NO: 55074

SEQ ID NO: 55091 - protein, 190 aa, Homo sapiens; identical to SEQ ID NO: 55073

SEQ ID NO: 55092 - protein, 201 aa, Homo sapiens; identical to SEQ ID NO: 55071

SEQ ID NO: 55093 - protein, 165 aa, Homo sapiens; identical to SEQ ID NO: 55072

SEQ ID NO: 55094 - protein, 177 aa, Homo sapiens; identical to SEQ ID NO: 55074

SEQ ID NO: 55095 - protein, 190 aa, Homo sapiens; identical to SEQ ID NO: 55073

SEQ ID NO: 55096 - protein, 177 aa, Homo sapiens; identical to SEQ ID NO: 55074

SEQ ID NO: 55097 - protein, 201 aa, Homo sapiens; identical to SEQ ID NO: 55071

SEQ ID NO: 55098 - protein, 190 aa, Homo sapiens; identical to SEQ ID NO: 55073

SEQ ID NO: 55099 - protein, 165 aa, Homo sapiens; identical to SEQ ID NO: 55072

SEQ ID NO: 55100 - protein, 165 aa, Homo sapiens; identical to SEQ ID NO: 55072

SEQ ID NO: 55101 - protein, 177 aa, Homo sapiens; identical to SEQ ID NO: 55074

SEQ ID NO: 55102 - protein, 190 aa, Homo sapiens; identical to SEQ ID NO: 55073

SEQ ID NO: 55103 - protein, 1462 aa, Homo sapiens
MGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKDENFILKHDRAFLLSMANRGKHTNGSQFFITTKPAPHLDGVHVVFGLVISGFEVIEQIENLKTDAASRPYADVRVIDCGVLATKSIKDVFEKKRKKPTHSEGSDSSSNSSSSSESSSESELEHERSRRRKHKRRPKVKRSKKRRKEASSSEEPRNKHAMNPKGHSERSDTNEKRSVDSSAKREKPVVRPEEIPPVPENRFLLRRDMPVVTAEPEPKIPDVAPIVSDQKPSVSKSGRKIKGRGTIRYHTPPRSRSCSESDDDDSSETPPHWKEEMQRLRAYRPPSGEKWSKGDKLSDPCSSRWDERSLSQRSRSWSYNGYYSDLSTARHSGHHKKRRKEKKVKHKKKGKKQKHCRRHKQTKKRRILIPSDIESSKSSTRRMKSSCDRERSSRSSSLSSHHSSKRDWSKSDKDVQSSLTHSSRDSYRSKSHSQSYSRGSSRSRTASKSSSHSRSRSKSRSSSKSGHRKRASKSPRKTASQLSENKPVKTEPLRATMAQNENVVVQPVVAENIPVIPLSDSPPPSRWKPGQKPWKPSYERIQEMKAKTTHLLPIQSTYSLANIKETGSSSSYHKREKNSESDQSTYSKYSDRSSESSPRSRSRSSRSRSYSRSYTRSRSLASSHSRSRSPSSRSHSRNKYSDHSQCSRSSSYTSISSDDGRRAKRRLRSSGKKNSVSHKKHSSSSEKTLHSKYVKGRDRSSCVRKYSESRSSLDYSSDSEQSSVQATQSAQEKEKQGQMERTHNKQEKNRGEEKSKSERECPHSKKRTLKENLSDHLRNGSKPKRKNYAGSKWDSESNSERDVTKNSKNDSHPSSDKEEGEATSDSESEVSEIHIKVKPTTKSSTNTSLPDDNGAWKSSKQRTSTSDSEGSCSNSENNRGKPQKHKHGSKENLKREHTKKVKEKLKGKKDKKHKAPKRKQAFHWQPPLEFGEEEEEEIDDKQVTQESKEKKVSENNETIKDNILKTEKSSEEDLSGKHDTVTVSSDLDQFTKDDSKLSISPTALNTEENVACLQNIQHVEESVPNGVEDVLQTDDNMEICTPDRSSPAKVEETSPLGNARLDTPDINIVLKQDMATEHPQAEVVKQESSMSESKVLGEVGKQDSSSASLASAGESTGKKEVAEKSQINLIDKKWKPLQGVGNLAAPNAATSSAVEVKVLTTVPEMKPQGLRIEIKSKNKVRPGSLFDEVRKTARLNRRPRNQESSSDEQTPSRDDDSQSRSPSRSRSKSETKSRHRTRSVSYSHSRSRSRSSTSSYRSRSYSRSRSRGWYSRGRTRSRSSSYRSYKSHRTSSRSRSRSSSYDPHSRSRSYTYDSYYSRSRSRSRSQRSDSYHRGRSYNRRSRSCRSYGSDSESDRSYSHHRSPSESSRYS

SEQ ID NO: 55104 - protein, 104 aa, Homo sapiens
MGAQDRPQCHFDIEINREPVGRIMFQLFSDICPKTCKNFLCLCSGEKGLGKTTGKKLCYKGSTFHRVVKNFMIQGGDFSEGNGKGGESIYGGYFKENVVFCKMK

SEQ ID NO: 55105 - protein, 380 aa, Homo sapiens
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIYDLNIPAFVKFAYVAEREDELSLVKGSRVTVMEKCSDGWWRGSYNGQIGWFPSNYVLEEVDEAAAESPSFLSLRKGASLSNGQGSRVLHVVQTLYPFSSVTEEELNFEKGETMEVIEKPENDPEWWKCKNARGQVGLVPKNYVVVLSDGPALHPAHAPQISYTGPSSSGRFAGREWYYGNVTRHQAECALNERGVEGDFLIRDSESSPSDFSVSLKASGKNKHFKVQLVDNVYCIGQRRFHTMDELVEHYKKAPIFTSEHGEKLYLVRALQ

SEQ ID NO: 55106 - protein, 144 aa, Homo sapiens
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIYDLNIPAFVKFAYVAEREDELSLVKGSRVTVMEKC

SEQ ID NO: 55107 - protein, 380 aa, Homo sapiens; identical to SEQ ID NO: 55105

SEQ ID NO: 55108 - protein, 110 aa, Homo sapiens
MTEEVIVIAKWDYTAQQDQELDIKKNERLWLLDDSKTWWRVRNAANRTGYVPSNYVERKNSLKKGSLVKNLKDTLGLGKTRRKTSARDASPTPSTDAEYPANGSGADRIY

SEQ ID NO: 55109 - protein, 83 aa, Homo sapiens
MTEEVIVIAKWDYTAQQDQELDIKKNERLWLLDDSKTWWRVRNAANRTGYVPSNYVERKNSLKKGSLVKNLKDTLAQRLLRVP

SEQ ID NO: 55110 - protein, 83 aa, Homo sapiens; identical to SEQ ID NO: 55109

SEQ ID NO: 55111 - protein, 722 aa, Homo sapiens
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 55112 - protein, 722 aa, Homo sapiens
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPLPSSQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKGPFGAGQRPWPGVPRLLEPGSTPSREPHPVERSGVPALTSSWASGCPRPLHPALQLVIDSAFGGRSV

SEQ ID NO: 55113 - protein, 715 aa, Homo sapiens
MYRALYAFRSAEPNALAFAAGETFLVLERSSAHWWLAARARSGETGYVPPAYLRRLQGLEQDVLQAIDRAIEAVHNTAMRDGGKYSLEQRGVLQKLIHHRKETLSRRGPSASSVAVMTSSTSDHHLDAAAARQPNGVCRAGFERQHSLPSSEHLGADGGLYQIPPQPRRAAPTTPPPPVKRRDREALMASGSGGHNTMPSGGNSVSSGSSVSSTSLDTLYTSSSPSEPGSSCSPTPPPVPRRGTHTTVSQVQPPPSKASAPEPPAEEEVATGTTSASDDLEALGTLSLGTTEEKAAAEAAVPRTIGAELMELVRRNTGLSHELCRVAIGIIVGHIQASVPASSPVMEQVLLSLVEGKDLSMALPSGQVCHDQQRLEVIFADLARRKDDAQQRSWALYEDEGVIRCYLEELLHILTDADPEVCKKMCKRNEFESVLALVAYYQMEHRASLRLLLLKCFGAMCSLDAAIISTLVSSVLPVELARDMQTDTQDHQKLCYSALILAMVFSMGEAVPYAHYEHLGTPFAQFLLNIVEDGLPLDTTEQLPDLCVNLLLALNLHLPAADQNVIMAALSKHANVKIFSEKLLLLLNRGDDPVRIFKHEPQPPHSVLKFLQDVFGSPATAAIFYHTDMMALIDITVRHIADLSPGDKLRMEYLSLMHAIVRTTPYLQHRHRLPDLQAILRRILNEEETSPQCQMDRMIVREMCKEFLVLGEAPS

SEQ ID NO: 55114 - protein, 1134 aa, Homo sapiens
MSRSVLQPSQQKLAEKLTILNDRGVGMLTRLYNIKKQGQVWKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 55115 - protein, 1128 aa, Homo sapiens
MSRSVLQPSQQKLAEKLTILNDRGVGMLTRLYNIKKACGDPKAKPSYLIDKNLESAVKFIVRKFPAVETRNNNQQLAQLQKEKSEILKNLALYYFTFVDVMEFKDHVCELLNTIDVCQVFFDITVNFDLTKNYLDLIITYTTLMILLSRIEERKAIIGLYNYAHEMTHGASDREYPRLGQMIVDYENPLKKMMEEFVPHSKSLSDALISLQMVYPRRNLSADQWRNAQLLSLISAPSTMLNPAQSDTMPCEYLSLDAMEKWIIFGFILCHGILNTDATALNLWKLALQSSSCLSLFRDEVFHIHKAAEDLFVNIRGYNKRINDIRECKEAAVSHAGSMHRERRKFLRSALKELATVLSDQPGLLGPKALFVFMALSFARDEIIWLLRHADNMPKKSADDFIDKHIAELIFYMEELRAHVRKYGPVMQRYYVQYLSGFDAVVLNELVQNLSVCPEDESIIMSSFVNTMTSLSVKQVEDGEVFDFRGMRLDWFRLQAYTSVSKASLGLADHRELGKMMNTIIFHTKMVDSLVEMLVETSDLSIFCFYSRAFEKMFQQCLELPSQSRYSIAFPLLCTHFMSCTHELCPEERHHIGDRSLSLCNMFLDEMAKQARNLITDICTEQCTLSDQLLPKHCAKTISQAVNKKSKKQTGKKGEPEREKPGVESMRKNRLVVTNLDKLHTALSELCFSINYVPNMVVWEHTFTPREYLTSHLEIRFTKSIVGMTMYNQATQEIAKPSELLTSVRAYMTVLQSIENYVQIDITRVFNNVLLQQTQHLDSHGEPTITSLYTNWYLETLLRQVSNGHIAYFPAMKAFVNLPTENELTFNAEEYSDISEMRSLSELLGPYGMKFLSESLMWHISSQVAELKKLVVENVDVLTQMRTSFDKPDQMAALFKRLSSVDSVLKRMTIIGVILSFRSLAQEALRDVLSYHIPFLVSSIEDFKDHIPRETDMKVAMNVYELSSAAGLPCEIDPALVVALSSQKSENISPEEEYKIACLLMVFVAVSLPTLASNVMSQYSPAIEGHCNNIHCLAKAINQIAAALFTIHKGSIEDRLKEFLALASSSLLKIGQETDKTTTRNRESVYLLLDMIVQESPFLTMDLLESCFPYVLLRNAYHAVYKQSVTSSA

SEQ ID NO: 55116 - protein, 882 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYCVAYGVGIIGFFKANENSLLSAQLKGFPLFLHSNLGLKDCSINPKSPLLYVTRPSEVEKGVLPGEDWTVFQSNHSTYEPVLLAKTRSSESIPHLGADAGLHAALHATVVQDLGLHDGIQRVLFGNNLNFWLHKLVFVDAVAFLTGKRLSLPLDRYILVDIDDIFVGKEGTRMKVEDVKALFDTQNELRAHIPNFTFNLGYSGKFFHTGTNAEDAGDDLLLSYVKEFWWFPHMWSHMQPHLFHNQSVLAEQMALNKKFAVEHGIPTDMGYAVAPHHSGVYPVHVQLYEAWKQVWSIRVTSTEEYPHLKPARYRRGFIHNGIMVLPRQTCGLFTHTIFYNEYPGGSSELDKIINGGELFLTVLLNPISIFMTHLSNYGNDRLGLYTFKHLVRFLHSWTNLRLQTLPPVQLAQKYFQIFSEEKDPLWQDPCEDKRHKDIWSKEKTCDRFPKLLIIGPQKTGTTALYLFLGMHPDLSSNYPSSETFEEIQFFNGHNYHKGIDWYMEFFPIPSNTTSDFYFEKSANYFDSEVAPRRAAALLPKAKVLTILINPADRAYSWYQHQRAHDDPVALKYTFHEVITAGSDASSKLRALQNRCLVPGWYATHIERWLSAYHANQILVLDGKLLRTEPAKVMDMVQKFLGVTNTIDYHKTLAFDPKKGFWCQLLEGGKTKCLGKSKGRKYPEMDLDSRAFLKDYYRDHNIELSKLLYKMGQTLPTWLREDLQNTR

SEQ ID NO: 55117 - protein, 23 aa, Homo sapiens
MPALACLRRLCRHVSPQAVLFLL

SEQ ID NO: 55118 - protein, 159 aa, Homo sapiens
MPALACLRRLCRHVSPQAVLFLLFIFCLFSVFISAYYLYGWKRGLEPSADAPEPDCGDPPPVAPSRLLPLKPVQAATPSRTDPLVLVFVESLYSQLGQEVVAILESSRFKYRTEIAPGKGDMPTLTDKGRGRFALIIYENILKYVNLDAWNRELLDKYC

SEQ ID NO: 55119 - protein, 68 aa, Homo sapiens
MPALACLRRLCRHVSPQAVLFLLFIFCLFSVFISAYYLYGWKRGLEPSADAPEPDCGDPPPVAPSRLL

SEQ ID NO: 55120 - protein, 760 aa, Homo sapiens
MPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 55121 - protein, 883 aa, Homo sapiens
MLQLWKVVRPARQLELHRLILLLIAFSLGSMGFLAYYVSTSPKAKEPLPLPLGDCSSGGAAGPGPARPPVPPRPPRPPETARTEPVVLVFVESAYSQLGQEIVAILESSRFRYSTELAPGRGDMPTLTDNTHGRYVLVIYENLLKYVNLDAWSRELLDRYCVEYGVGIIGFFRAHEHSLLSAQLKGFPLFLHSNLGLRDYQVNPSAPLLHLTRPSRLEPGPLPGDDWTIFQSNHSTYEPVLLASLRPAEPAVPGPVLRRARLPTVVQDLGLHDGIQRVLFGHGLSFWLHKLIFVDAVAYLTGKRLCLDLDRYILVDIDDIFVGKEGTRMKVADVEALLTTQNKLRTLVPNFTFNLGFSGKFYHTGTEEEDAGDDMLLKHRKEFWWFPHMWSHMQPHLFHNRSVLADQMRLNKQFALEHGIPTDLGYAVAPHHSGVYPIHTQLYEAWKSVWGIQVTSTEEYPHLRPARYRRGFIHNGIMVLPRQTCGLFTHTIFYNEYPGGSRELDRSIRGGELFLTVLLNPISIFMTHLSNYGNDRLGLYTFESLVRFLQCWTRLRLQTLPPVPLAQKYFELFPQERSPLWQNPCDDKRHKDIWSKEKTCDRLPKFLIVGPQKTGTTAIHFFLSLHPAVTSSFPSPSTFEEIQFFNSPNYHKGIDWYMDFFPVPSNASTDFLFEKSATYFDSEVVPRRGAALLPRAKIITVLTNPADRAYSWYQHQRAHGDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTESRLFLTDFFRNHNLELSKLLSRLGQPVPSWLREELQHSSLG

SEQ ID NO: 55122 - protein, 149 aa, Homo sapiens
GDPVALNYTFYQVISASSQTPLALRSLQNRCLVPGYYSTHLQRWLTYYPSGQLLIVDGQELRTNPAASMESIQKFLGITPFLNYTRTLRFDDDKGFWCQGLEGGKTRCLGRSKGRRYPDMDTEVSKARGRGIPLHFQDLILCPTSYHFC

SEQ ID NO: 55123 - protein, 231 aa, Homo sapiens
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQVRL

SEQ ID NO: 55124 - protein, 1014 aa, Homo sapiens
MRVPVFEDIKDETEEEKIGEEENEEDQVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAAKGFSDYAHMKEPPEVKHAMEVNKHQSNISYRKDVQDTHTYSAELDRPDIKMATQISKIISNAEYKKGQGIMNKEPAVIGRPDFEHAVEASKLSSQIKYKEKFDNEMKDKKHHYNPLESASFRQNQLAATLASNVKYKKDIQNMHDPVSDLPNLLFLDHVLKASKMLSGREYKKLFEENKGMYHFDADAVEHLHHKGNAVLQSQVKYKEEYEKNKGKPMLEFVETPSYQASKEAQKMQSEKVYKEDFEKEIKGRSSLDLDKTPEFLHVKYITNLLREKEYKKDLENEIKGKGMELNSEVLDIQRAKRASEMASEKEYKKDLESIIKGKGMQAGTDTLEMQHAKKAAEIASEKDYKRDLETEIKGKGMQVSTDTLDVQRAKKASEMASQKQYKKDLENEIKGKGMQVSMDIPDILRAKRTSEIYSQRKYKDEAEKMLSNYSTIADTPEIQRIKTTQQNISAVFYKKEVGAGTAVKDSPEIERVKKNQQNISSVKYKEEIKHATAISDPPELKRVKENQKNISNLQYKEQNYKATPVSMTPEIERVRRNQEQLSAVKYKGELQRGTAISDPPELKRAKENQKNISNVYYRGQLGRATTLSVTPEMERVKKNQENISSVKYTQDHKQMKGRPSLILDTPAMRHVKEAQNHISMVKYHEDFEKTKGRGFTPVVDDPVTERVRKNTQVVSDAAYKGVHPHIVEMDRRPGIIVDLKVWRTDPGSIFDLDPLEDNIQSRSLHMLSEKASHYRRHWSRSHSSSTFGTGLGDDRSEISEIYPSFSCCSEVTRPSDEGAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVN

SEQ ID NO: 55125 - protein, 236 aa, Homo sapiens
MLHFYYEWLHSGSRGAVPKPLHYPKQSFTTVADTPENLRLKQQSELQSQVKYKRDFEESKGRGFSIVTDTPELQRLKRTQEQISNVKYHEDFEKTKGRGFTPVVDDPVTERVRKNTQVVSDAAYKGVHPHIVEMDRRPGIIVAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVN

SEQ ID NO: 55126 - protein, 270 aa, Homo sapiens
MNPQCARCGKVVYPTEKVNCLDKYWHKGCFHCEVCKMALNMNNYKGYEKKPYCNAHYPKQSFTTVADTPENLRLKQQSELQSQVKYKRDFEESKGRGFSIVTDTPELQRLKRTQEQISNVKYHEDFEKTKGRGFTPVVDDPVTERVRKNTQVVSDAAYKGVHPHIVEMDRRPGIIVAPVLPGAYQQSHSQGYGYMHQTSVSSMRSMQHSPNLRTYRAMYDYSAQDEDEVSFRDGDYIVNVQPIDDGWMYGTVQRTGRTGMLPANYIEFVN

SEQ ID NO: 55127 - protein, 117 aa, Homo sapiens
MRNNCTASLMKVFYKPVIEDLSMELARKCTELISDIRYKEEFKKSKDKCTFVTDSPMLNHVKNIGAFISEAKYKGTIKADLSNSLYKRMPATIDSVFAGEVTQLQSEVAYKQKHDAA

SEQ ID NO: 55128 - protein, 6669 aa, Homo sapiens
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55129 - protein, 500 aa, Homo sapiens
MERVKRNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55130 - protein, 2625 aa, Homo sapiens
MPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENMGKGTPLPVTPEMERVKHNQENISSVLYKENVGKATATPVTPEMQRVKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55131 - protein, 8525 aa, Homo sapiens
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARMNKINYSESLYKLANEEAKKKGYDLRSDAIPIVAAKASRDIISDYKYKDGYCKQLGHHIGARNIEDDPKMMWSMHVAKIQSDREYKKDFEKWKTKFSSPVDMLGVVLAKKCQTLVSDVDYKNYLHEWTCLPDQSDVIHARQAYDLQSDNIYKSDLQWLRGIGWVPIGSMDVVKCKRATEILSDNIYRQPPDKLKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDAKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRNAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNERKYKSSAKMFLQHGCNEILRPDMLTALYNSHMWSQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSILYKENLSKGTPLPVTPEMERVKLNQENFSSVLYKENVGKGIPIPITPEMERVKHNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55132 - protein, 6669 aa, Homo sapiens
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55133 - protein, 8525 aa, Homo sapiens
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKGKMIGVLSINDDPKMLHSLKVAKNQSDRLYKENYEKTKAKSMNYCETPKYQLDTQLKNFSEARYKDLYVKDVLGHYVGSMEDPYHTHCMKVAAQNSDKSYKAEYEEDKGKCYFPQTITQEYEAIKKLDQCKDHTYKVHPDKTKFTAVTDSPVLLQAQLNTKQLSDLNYKAKHEGEKFKCHIPADAPQFIQHRVNAYNLSDNVYKQDWEKSKAKKFDIKVDAIPLLAAKANTKNTSDVMYKKDYEKSKGKMIGALSINDDPKMLHSLKTAKNQSDREYRKDYEKSKTIYTAPLDMLQVTQAKKSQAIASDVDYKHILHSYSYPPDSINVDLAKKAYALQSDVEYKADYNSWMKGCGWVPFGSLEMEKAKRASDILNEKKYRQHPDTLKFTSIEDAPITVQSKINQAQRSDIAYKAKGEEIIHKYNLPPDLPQFIQAKVNAYNISENMYKADLKDLSKKGYDLRTDAIPIRAAKAARQAASDVQYKKDYEKAKGKMVGFQSLQDDPKLVHYMNVAKIQSDREYKKDYEKTKSKYNTPHDMFNVVAAKKAQDVVSNVNYKHSLHHYTYLPDAMDLELSKNMMQIQSDNVYKEDYNNWMKGIGWIPIGSLDVEKVKKAGDALNEKKYRQHPDTLKFTSIVDSPVMVQAKQNTKQVSDILYKAKGEDVKHKYTMSPDLPQFLQAKCNAYNISDVCYKRDWYDLIAKGNNVLGDAIPITAAKASRNIASDYKYKEAYEKSKGKHVGFRSLQDDPKLVHYMNVAKLQSDREYKKNYENTKTSYHTPGDMVSITAAKMAQDVATNVNYKQPLHHYTYLPDAMSLEHTRNVNQIQSDNVYKDEYNSFLKGIGWIPIGSLEVEKVKKAGDALNERKYRQHPDTVKFTSVPDSMGMVLAQHNTKQLSDLNYKVEGEKLKHKYTIDPELPQFIQAKVNALNMSDAHYKADWKKTIAKGYDLRPDAIPIVAAKSSRNIASDCKYKEAYEKAKGKQVGFLSLQDDPKLVHYMNVAKIQSDREYKKGYEASKTKYHTPLDMVSVTAAKKSQEVATNANYRQSYHHYTLLPDALNVEHSRNAMQIQSDNLYKSDFTNWMKGIGWVPIESLEVEKAKKAGEILSEKKYRQHPEKLKFTYAMDTMEQALNKSNKLNMDKRLYTEKWNKDKTTIHVMPDTPDILLSRVNQITMSDKLYKAGWEEEKKKGYDLRPDAIAIKAARASRDIASDYKYKKAYEQAKGKHIGFRSLEDDPKLVHFMQVAKMQSDREYKKGYEKSKTSFHTPVDMLSVVAAKKSQEVATNANYRNVIHTYNMLPDAMSFELAKNMMQIQSDNQYKADYADFMKGIGWLPLGSLEAEKNKKAMEIISEKKYRQHPDTLKYSTLMDSMNMVLAQNNAKIMNEHLYKQAWEADKTKVHIMPDIPQIILAKANAINMSDKLYKLSLEESKKKGYDLRPDAIPIKAAKASRDIASDYKYKYNYEKGKGKMVGFRSLEDDPKLVHSMQVAKMQSDREYKKNYENTKTSYHTPADMLSVTAAKDAQANITNTNYKHLIHKYILLPDAMNIELTRNMNRIQSDNEYKQDYNEWYKGLGWSPAGSLEVEKAKKATEYASDQKYRQHPSNFQFKKLTDSMDMVLAKQNAHTMNKHLYTIDWNKDKTKIHVMPDTPDILQAKQNQTLYSQKLYKLGWEEALKKGYDLPVDAISVQLAKASRDIASDYKYKQGYRKQLGHHVGFRSLQDDPKLVLSMNVAKMQSEREYKKDFEKWKTKFSSPVDMLGVVLAKKCQELVSDVDYKNYLHQWTCLPDQNDVVQAKKVYELQSENLYKSDLEWLRGIGWSPLGSLEAEKNKRASEIISEKKYRQPPDRNKFTSIPDAMDIVLAKTNAKNRSDRLYREAWDKDKTQIHIMPDTPDIVLAKANLINTSDKLYRMGYEELKRKGYDLPVDAIPIKAAKASREIASEYKYKEGFRKQLGHHIGARNIEDDPKMMWSMHVAKIQSDREYKKDFEKWKTKFSSPVDMLGVVLAKKCQTLVSDVDYKNYLHQWTCLPDQSDVIHARQAYDLQSDNLYKSDLQWLKGIGWMTSGSLEDEKNKRATQILSDHVYRQHPDQFKFSSLMDSIPMVLAKNNAITMNHRLYTEAWDKDKTTVHIMPDTPEVLLAKQNKVNYSEKLYKLGLEEAKRKGYDMRVDAIPIKAAKASRDIASEFKYKEGYRKQLGHHIGARAIRDDPKMMWSMHVAKIQSDREYKKDFEKWKTKFSSPVDMLGVVLAKKCQTLVSDVDYKNYLHQWTCLPDQSDVIHARQAYDLQSDNMYKSDLQWMRGIGWVSIGSLDVEKCKRATEILSDKIYRQPPDRFKFTSVTDSLEQVLAKNNAITMNKRLYTEAWDKDKTQIHIMPDTPEIMLARMNKINYSESLYKLANEEAKKKGYDLRSDAIPIVAAKASRDIISDYKYKDGYCKQLGHHIGARNIEDDPKMMWSMHVAKIQSDREYKKDFEKWKTKFSSPVDMLGVVLAKKCQTLVSDVDYKNYLHEWTCLPDQSDVIHARQAYDLQSDNIYKSDLQWLRGIGWVPIGSMDVVKCKRATEILSDNIYRQPPDKLKFTSVTDSLEQVLAKNNALNMNKRLYTEAWDKDKTQIHIMPDTPEIMLARQNKINYSETLYKLANEEAKKKGYDLRSDAIPIVAAKASRDVISDYKYKDGYRKQLGHHIGARNIEDDPKMMWSMHVAKIQSDREYKKDFEKWKTKFSSPVDMLGVVLAKKCQTLVSDVDYKNYLHEWTCLPDQNDVIHARQAYDLQSDNIYKSDLQWLRGIGWVPIGSMDVVKCKRAAEILSDNIYRQPPDKLKFTSVTDSLEQVLAKNNALNMNKRLYTEAWDKDKTQVHIMPDTPEIMLARQNKINYSESLYRQAMEEAKKEGYDLRSDAIPIVAAKASRDIASDYKYKEAYRKQLGHHIGARAVHDDPKIMWSLHIAKVQSDREYKKDFEKYKTRYSSPVDMLGIVLAKKCQTLVSDVDYKHPLHEWICLPDQNDIIHARKAYDLQSDNLYKSDLEWMKGIGWVPIDSLEVVRAKRAGELLSDTIYRQRPETLKFTSITDTPEQVLAKNNALNMNKRLYTEAWDNDKKTIHVMPDTPEIMLAKLNRINYSDKLYKLALEESKKEGYDLRLDAIPIQAAKASRDIASDYKYKEGYRKQLGHHIGARNIKDDPKMMWSIHVAKIQSDREYKKEFEKWKTKFSSPVDMLGVVLAKKCQILVSDIDYKHPLHEWTCLPDQNDVIQARKAYDLQSDAIYKSDLEWLRGIGWVPIGSVEVEKVKRAGEILSDRKYRQPADQLKFTCITDTPEIVLAKNNALTMSKHLYTEAWDADKTSIHVMPDTPDILLAKSNSANISQKLYTKGWDESKMKDYDLRADAISIKSAKASRDIASDYKYKEAYEKQKGHHIGAQSIEDDPKIMCAIHAGKIQSEREYKKEFQKWKTKFSSPVDMLSILLAKKCQTLVTDIDYRNYLHEWTCMPDQNDIIQAKKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDAKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRNAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHHWSCFPDQNDVIQARKAYDLQSDSVYKADLEWLRGIGWMPEGSVEMNRVKVAQDLVNERLYRTRPEALSFTSIVDTPEVVLAKANSLQISEKLYQEAWNKDKSNITIPSDTPEMLQAHINALQISNKLYQKDWNDTKQKGYDIRADAIEIKHAKASREIASEYKYKEGYRKQLGHHMGFRTLQDDPKSVWAIHAAKIQSDREYKKAYEKSKGIHNTPLDMMSIVQAKKCQVLVSDIDYRNYLHQWTCLPDQNDVIQAKKAYDLQSDNLYKSDLEWLKGIGWLPEGSVEVMRVKNAQNLLNERLYRIKPEALKFTSIVDTPEVIQAKINAVQISEPLYRDAWEKEKANVNVPADTPLMLQSKINALQISNKRYQQAWEDVKMTGYDLRADAIGIQHAKASRDIASDYLYKTAYEKQKGHYIGCRSAKEDPKLVWAANVLKMQNDRLYKKAYNDHKAKISIPVDMVSISAAKEGQALASDVDYRHYLHRWSCFPDQNDVIQARKAYDLQSDALYKADLEWLRGIGWMPQGSPEVLRVKNAQNIFCDSVYRTPVVNLKYTSIVDTPEVVLAKSNAENISIPKYREVWDKDKTSIHIMPDTPEINLARANALNVSNKLYREGWDEMKAGCDVRLDAIPIQAAKASREIASDYKYKLDHEKQKGHYVGTLTARDDNKIRWALIADKLQNEREYRLDWAKWKAKIQSPVDMLSILHSKNSQALVSDMDYRNYLHQWTCMPDQNDVIQAKKAYELQSDNVYKADLEWLRGIGWMPNDSVSVNHAKHAADIFSEKKYRTKIETLNFTPVDDRVDYVTAKQSGEILDDIKYRKDWNATKSKYTLTETPLLHTAQEAARILDQYLYKEGWERQKATGYILPPDAVPFVHAHHCNDVQSELKYKAEHVKQKGHYVGVPTMRDDPKLVWFEHAGQIQNERLYKEDYHKTKAKINIPADMVSVLAAKQGQTLVSDIDYRNYLHQWMCHPDQNDVIQARKAYDLQSDNVYRADLEWLRGIGWIPLDSVDHVRVTKNQEMMSQIKYKKNALENYPNFRSVVDPPEIVLAKINSVNQSDVKYKETFNKAKGKYTFSPDTPHISHSKDMGKLYSTILYKGAWEGTKAYGYTLDERYIPIVGAKHADLVNSELKYKETYEKQKGHYLAGKVIGEFPGVVHCLDFQKMRSALNYRKHYEDTKANVHIPNDMMNHVLAKRCQYILSDLEYRHYFHQWTSLLEEPNVIRVRNAQEILSDNVYKDDLNWLKGIGCYVWDTPQILHAKKSYDLQSQLQYTAAGKENLQNYNLVTDTPLYVTAVQSGINASEVKYKENYHQIKDKYTTVLETVDYDRTRNLKNLYSSNLYKEAWDRVKATSYILPSSTLSLTHAKNQKHLASHIKYREEYEKFKALYTLPRSVDDDPNTARCLRVGKLNIDRLYRSVYEKNKMKIHIVPDMVEMVTAKDSQKKVSEIDYRLRLHEWICHPDLQVNDHVRKVTDQISDIVYKDDLNWLKGIGCYVWDTPEILHAKHAYDLRDDIKYKAHMLKTRNDYKLVTDTPVYVQAVKSGKQLSDAVYHYDYVHSVRGKVAPTTKTVDLDRALHAYKLQSSNLYKTSLRTLPTGYRLPGDTPHFKHIKDTRYMSSYFKYKEAYEHTKAYGYTLGPKDVPFVHVRRVNNVTSERLYRELYHKLKDKIHTTPDTPEIRQVKKTQEAVSELIYKSDFFKMQGHMISLPYTPQVIHCRYVGDITSDIKYKEDLQVLKGFGCFLYDTPDMVRSRHLRKLWSNYLYTDKARKMRDKYKVVLDTPEYRKVQELKTHLSELVYRAAGKKQKSIFTSVPDTPDLLRAKRGQKLQSQYLYVELATKERPHHHAGNQTTALKHAKDVKDMVSEKKYKIQYEKMKDKYTPVPDTPILIRAKRAYWNASDLRYKETFQKTKGKYHTVKDALDIVYHRKVTDDISKIKYKENYMSQLGIWRSIPDRPEHFHHRAVTDTVSDVKYKEDLTWLKGIGCYAYDTPDFTLAEKNKTLYSKYKYKEVFERTKSDFKYVADSPINRHFKYATQLMNEKKYRADYEQRKDKYHLVVDEPRHLLAKTAGDQISQIKYRKNYEKSKDKFTSIVDTPEHLRTTKVNKQISDILYKLEYNKAKPRGYTTIHDTPMLLHVRKVKDEVSDLKYKEVYQRNKSNCTIEPDAVHIKAAKDAYKVNTNLDYKKQYEANKAHWKWTPDRPDFLQAAKSSLQQSDFEYKLDREFLKGCKLSVTDDKNTVLALRNTLIESDLKYKEKHVKERGTCHAVPDTPQILLAKTVSNLVSENKYKDHVKKHLAQGSYTTLPETRDTVHVKEVTKHVSDTNYKKKFVKEKGKSNYSIMLEPPEVKHAMEVAKKQSDVAYRKDAKENLHYTTVADRPDIKKATQAAKQASEVEYRAKHRKEGSHGLSMLGRPDIEMAKKAAKLSSQVKYRENFDKEKGKTPKYNPKDSQLYKVMKDANNLASEVKYKADLKKLHKPVTDMKESLIMNHVLNTSQLASSYQYKKKYEKSKGHYHTIPDNLEQLHLKEATELQSIVKYKEKYEKERGKPMLDFETPTYITAKESQQMQSGKEYRKDYEESIKGRNLTGLEVTPALLHVKYATKIASEKEYRKDLEESIRGKGLTEMEDTPDMLRAKNATQILNEKEYKRDLELEVKGRGLNAMANETPDFMRARNATDIASQIKYKQSAEMEKANFTSVVDTPEIIHAQQVKNLSSQKKYKEDAEKSMSYYETVLDTPEIQRVRENQKNFSLLQYQCDLKNSKGKITVVQDTPEILRVKENQKNFSSVLYKEDVSPGTAIGKTPEMMRVKQTQDHISSVKYKEAIGQGTPIPDLPEVKRVKETQKHISSVMYKENLGTGIPTTVTPEIERVKRNQENFSSVLYKENLGKGIPTPITPEMERVKRNQENFSSILYKENLSKGTPLPVTPEMERVKLNQENFSSVLYKENVGKGIPIPITPEMERVKHNQENFSSVLYKENLGTGIPIPITPEMQRVKHNQENLSSVLYKENMGKGTPLPVTPEMERVKHNQENISSVLYKENMGKGTPLPVTPEMERVKHNQENISSVLYKENMGKGTPLAVTPEMERVKHNQENISSVLYKENVGKATATPVTPEMQRVKRNQENISSVLYKENLGKATPTPFTPEMERVKRNQENFSSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55134 - protein, 287 aa, Homo sapiens
MADDEDYEEVVEYYTEEVVYEEVPGETITKIYETTTTRTSDYEQSETSKPALAQPALAQPASAKPVERRKVIRKKVDPSKFMTPYIAHSQKMQDLFSPNKYKEKFEKTKGQPYASTTDTPELRRIKKVQDQLSEVKYRMDGDVAKTICHVDEKAKDIEHAKKVSQQVSKVLYKQNWEDTKDKYLLPPDAPELVQAVKNTAMFSKKLYTEDWEADKSLFYPYNDSPELRRVAQAQKALSDVAYKKGLAEQQAQFTPLADPPDIEFAKKVTNQVSKQKEKKRKKKRKKV

SEQ ID NO: 55135 - protein, 438 aa, Homo sapiens
MMRVKQTQDHISSVKYKEAIGQGTPIPDLPEVKRVKETQKHISSVMYKENLGTGIPTTVTPEIERVKRNQENFSSVLYKENMGKGTPLAVTPEMERVKHNQENISSVLYKENVGKATATPVTPEMQRVKRNQENISSVLYKENMRKATPTPVTPEMERAKRNQENISSVLYSDSFRKQIQGKAAYVLDTPEMRRVRETQRHISTVKYHEDFEKHKGCFTPVVTDPITERVKKNMQDFSDINYRGIQRKVVEMEQKRNDQDQETITGLRVWRTNPGSVFDYDPAEDNIQSRSLHMINVQAQRRSREQSRSASALSISGGEEKSEHSEAPDHHLSTYSDGGVFAVSTAYKHAKTTELPQQRSSSVATQQTTVSSIPSHPSTAGKIFRAMYDYMAADADEVSFKDGDAIINVQAIDEGWMYGTVQRTGRTGMLPANYVEAI

SEQ ID NO: 55136 - protein, 337 aa, Homo sapiens
QKYKEDYENKIKGKWSETPCFEVANARMNADNISTRKYQEDFENMKDQIYFMQTETPEYKMNKKAGVAASKVKYKEDYEKNKGKADYNVLPASENPQLRQLKAAGDALSDKLYKENYEKTKAKSINYCETPKFKLDTVLQNFSSDKKYKDSYLKDILGHYVGSFEDPYHSHCMKVTAQNSDKNYKAEYEEDRGKGFFPQTITQEYEAIKKLDQCKDHTYKVHPDKTKFTQVTDSPVLLQAQVNSKQLSDLNYKAKHESEKFKCHIPPDTPAFIQHKVNAYNLSDNLYKQDWEKSKAKKFDIKVDAIPLLAAKANTKNTSDVMYKKDYEKNKVKVQQR

SEQ ID NO: 55137 - protein, 1730 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55138 - protein, 1695 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSENKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55139 - protein, 852 aa, Homo sapiens
MRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNVHLLLSLKIKYKEEYEKTKGKAMGTADSRLLHSLQIAKMSSEVEYKKGFEESKTRFHLPMDMGVGWLTEGSLNLEQAKKAGQLVSEKNYRQRVDELKFTSVTDSSQMEHAKKSQELQSGVAYKAGNEQSVHQYTISKDEPLFLQARANAANLSEFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55140 - protein, 1738 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSEVEYKKDLESSRGHSINYCETPQFRNVSKISKFTSDNKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNVHLLLSLKIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55141 - protein, 1703 aa, Homo sapiens
MNVQPCSRCGYGVYPAEKISCIDQIWHKACFHCEVCKMMLSVNNFVSHQKKPYCHAHNPKNNTFTSVYHTPLNLNVRTFPEAISGIHDQEDGEQCKSVFHWDMKSKDKEGAPNRQPLANERAYWTGYGEGNAWCPGALPDPEIVRMVEARKSLGEEYTEDYEQPRGKGSFPAMITPAYQRAKKANQLASQVEYKRGHDERISRFSTVVDTPELLRSKAGAQLQSDVRYTEDYEQQRGKGSFPAMITPAYQIAKRANELASDVRYHQQYQKEMRGMAGPAIGAEGILTRECADQYGQGYPEEYEEHRGKGSFPAMITPAYQNAKKAHELASDIKYRQDFNKMKGAAHYHSLPAQDNLVLKQAQSVNKLVSENKYKENYQNHMRGRYEGVGMDRRTLHAMKVGSLASNVAYKADYKHDIVDYNYPATLTPSYQTAMKLVPLKDANYRQSIDKLKYSSVTDTPQIVQAKINAQQLSHVNYRADYEKNKLNYTLPQDVPQLVKAKTNAKLFSEVKYKEGWEKTKGKGFEMKLDAMSLLAAKASGELASNVHLLLSLKIKYKEEYEKTKGKAMGTADSRLLHSLQIAKMSSEVEYKKGFEESKTRFHLPMDMVNIRHAKKAQTLASDLDYRKKLHEYTVLPEDMKTQWAKKAYGLQSELQYKADLAWMKGVGWLTEGSLNLEQAKKAGQLVSEKNYRQRVDELKFTSVTDSSQMEHAKKSQELQSGVAYKAGNEQSVHQYTISKDEPLFLQARANAANLSEKLYKSSWENQKAKGFELRLDSLTFLAAKAKRDLASEVKYKEDYERSRGKLIGAKDVQGDSQMSHSLQMSKLQSELEYKKGFEDTKSQCHVSLDMVHLVHARKAQHLATDVGYKTAEHHFTALPTDMKVEWAKKAYGLQSDNQYRADVKWMKGMGWVATGSLNVEQAKKAGELISEKKYRQHPDALKFTSIKDTPEMVQARISYTQAVDRLYREQGENIKHHYTPTADLPEVLLAKLNAMNISETRYKESWSKLRDGGYKLRLDALPFQAAKASGEIISDYKYKEAFEKMKGQMLGSRSLEDDISLAHSVYATSLQSDVNYKKGFEHSKAQFHLPLDMAALVHAKKAQTLASNQDYKHPLPQYTSLAEDLRLSCAKKAHKLQSENLYRSDLNFMRGVACVIPGTLEIEGRKKASELISESKYRQHPHSFKYTAVTDTPNLLHAKFSNQITNERLYKAAGEDARHEYTMTLGLPEFIRAKTNAANLSDARYKESWRNLRAQGYKLTIEALPFQAARASGDIASDFLYRHDFVKERGKLIGPQSVRDDPRIQHCRRMGQLQSELQYRRGATSSQAQFHLPMDMVHLVHAKNAQALASDHDYRTQYHKFTALPEDLKMAWAKKAHALQSELRYKSDLIGMKGIGWLALRSPQMESAKKAGELISETKYRKKPDSIKFTTVVDSPDLVHAKNSYMHCNERMYRSGDAESLHRYTLIPDHPDFTRARLNALHLSDKVYRNSWEQTRAGSYDFRLDAIPFQTARASREIASDFRYKEAFLRDRGLQIGYRSVDDDPRMKHFLNVGRLQSDNEYKKDFAKSRSQFHSSTDQPGLLQAKRSQQLASDVHYRQPLPQPTCDPEQLGLRHAQKAHQLQSDVKYKSDLNLTRGVGWTPPGSYKVEMARRAAELANARGLGLQGAYRGAEAVEAGDHQSGEVNPDATEILHVKKKKALLL

SEQ ID NO: 55142 - protein, 275 aa, Homo sapiens
MATELEYESVLCVKPDVSVYRIPPRASNRGYRASDWKLDQPDWTGRLRITSKGKTAYIKLEDKVSGELFAQAPVEQYPGIAVETVTDSSRYFVIRIQDGTGRSAFIGIGFTDRGDAFDFNVSLQDHFKWVKQESEISKESQEMDARPKLDLGFKEGQTIKLCIGNITNKKGGASKPRTARGGGLSLLPPPPGGKVTIPPPSSSVAISNHVTPPPIPKSNHGGSDADILLDLDSPAPVTTPAPTPVSVSNDLWGDFSTASSSVPNQAPQPSNWVQF

SEQ ID NO: 55143 - protein, 133 aa, Homo sapiens [sequence omitted]

SEQ ID NO: 55144 - protein, 275 aa, Homo sapiens; identical to SEQ ID NO: 55142

SEQ ID NO: 55145 - protein, 185 aa, Homo sapiens
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIAVGLGNINRRCSCTLATAQSCHC

SEQ ID NO: 55146 - protein, 263 aa, Homo sapiens
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 55147 - protein, 263 aa, Homo sapiens; identical to SEQ ID NO: 55146

SEQ ID NO: 55148 - protein, 273 aa, Homo sapiens
MEESGYESVLCVKPDVHVYRIPPRATNRGYRAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSDQLPARPSQAQAGSSSDLSTVFPHVTSGKALPHLGQRKEDEALLSWPVFGA

SEQ ID NO: 55149 - protein, 237 aa, Homo sapiens
MEESGAAEWQLDQPSWSGRLRITAKGQMAYIKLEDRTSGELFAQAPVDQFPGTAVESVTDSSRYFVIRIEDGNGRRAFIGIGFGDRGDAFDFNVALQDHFKWVKQQCEFAKQAQNPDQGPKLDLGFKEGQTIKLNIANMKKKEGAAGNPRVRPASTGGLSLLPPPPGGKTSTLIPPPGEQLAVGGSLVQPAVAPSSGGAPVPWPQPNPATADIWGDFTKSTGSTSSQTQPGTGWVQF

SEQ ID NO: 55150 - protein, 263 aa, Homo sapiens; identical to SEQ ID NO: 55146

SEQ ID NO: 55151 - protein, 321 aa, Homo sapiens
MSEQSKDLSDPNFAAEAPNSEVHSSPGVSEGVPPSATLAEPQSPPLGPTAAPQAAPPPQAPNDEGDPKALQQAAEEGRAHQAPSAAQPGPAPPAPAQLVQKAHELMWYVLVKDQKKMIIWFPDMVKDVIGSYKKWCRSILRRTSLILARVFGLHLRLTSLHTMEFALVKALEPEELDRVALSNRMPMTGLLLMILSLIYVKGRGARESAVWNVLRILGLRPWKKHSTFGDVRKLITEEFVQMNYLKYQRVPYVEPPEYEFFWGSRASREITKMQIMEFLARVFKKDPQAWPSRYREALEEARALREANPTAHYPRSSVSED

SEQ ID NO: 55152 - protein, 304 aa, Homo sapiens
MLQKPRNRGRSGGQAERDRDWSHSGNPGASRAGEDARVLRDGFAEEAPSTSRGPGGSQGSQGPSPQGARRAQAAPAVGPRSQKQLELKVSELVQFLLIKDQKKIPIKRADILKHVIGDYKDIFPDLFKRAAERLQYVFGYKLVELEPKSNTYILINTLEPVEEDAEMRGDQGTPTTGLLMIVLGLIFMKGNTIKETEAWDFLRRLGVYPTKKHLIFGDPKKLITEDFVRQRYLEYRRIPHTDPVDYEFQWGPRTNLETSKMKVLKFVAKVHNQDPKDWPAQYCEALADEENRARPQPSGPAPSS

SEQ ID NO: 55153 - protein, 221 aa, Homo sapiens
MALALAALAAVEPACGSRYQQLQNEEESGEPEQAAGDAPPPYSSISAESAAYFDYKDESGFPKPPSYNVATTLPSYDEAERTKAEATIPLVPGRDEDFVGRDDFDDADQLRIGNDGIFMLTFFMAFLFNWIGFFLSFCLTTSAAGRYGAISGFGLSLIKWILIVRFSTYFPGYFDGQYWLWWVFLVLGFLLFLRGFINYAKVRKMPETFSNLPRTRVLFIY

SEQ ID NO: 55154 - protein, 153 aa, Homo sapiens
MALALAALAAVEPACGSRYQQLQNEEESGEPEQAAGDAPPPYSSISAESAAYFDYKDESGFPKPPSYNVATTLPSCFYDISHLIFFIFYLRNMKKKYTKMVKLLHKSAPAQSDSCKCPFICCVCISRISIGSRSGYQYIMHRSVGCLKAKQEN

SEQ ID NO: 55155 - protein, 336 aa, Homo sapiens
MARRRSQRVCASGPSMLNSARGAPELLRGTATNAEVSAAAAGATGSEELPPGDRGCRNGGGRGPAATTSSTGVAVGAEHGEDSLSRKPDPEPGRMDHHQPGTGRYQVLLNEEDNSESSAIEQPPTSNPAPQIVQAASSAPALETDSSPPPYSSITVEVPTTSDTEVYGEFYPVPPPYSVATSLPTYDEAEKAKAAAMAAAAAETSQRIQEEECPPRDDFSDADQLRVGNDGIFMLAFFMAFIFNWLGFCLSFCITNTIAGRYGAICGFGLSLIKWILIVRFSDYFTGYFNGQYWLWWIFLVLGLLLFFRGFVNYLKVRNMSESMAAAHRTRYFFLL

SEQ ID NO: 55156 - protein, 534 aa, Homo sapiens
MAQLGKLLKEQKYDRQLRLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 55157 - protein, 528 aa, Homo sapiens
MDAQQTKTNEARLWGDHGQEALESAHVCLINATATGTEILKNLVLPGIGSFTIIDGNQVSGEDAGNNFFLQRSSIGKNRAEAAMEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 55158 - protein, 445 aa, Homo sapiens
MEFLQELNSDVSGSFVEESPENLLDNDPSFFCRFTVVVATQLPESTSLRLADVLWNSQIPLLICRTYGLVGYMRIIIKEHPVIESHPDNALEDLRLDKPFPELREHFQSYDLDHMEKKDHSHTPWIVIIAKYLAQWYSETNGRIPKTYKEKEDFRDLIRQGILKNENGAPEDEENFEEAIKNVNTALNTTQIPSSIEDIFNDDRCINITKQTPSFWILARALKEFVAKEGQGNLPVRGTIPDMIADSGKYIKLQNVYREKAKKDAAAVGNHVAKLLQSIGQAPESISEKELKLLCSNSAFLRVVRCRSLAEEYGLDTINKDEIISSMDNPDNEIVLYLMLRAVDRFHKQQGRYPGVSNYQVEEDIGKLKSCLTGFLQEYGLSVMVKDDYVHEFCRYGAAEPHTIAAFLGGAAAQEVIKIITKQFVIFNNTYIYSGMSQTSATFQL

SEQ ID NO: 55159 - protein, 966 aa, Homo sapiens
MEPQVTLNVTFKNEIQSFLVSDPENTTWADIEAMVKVSFDLNTIQIKYLDEENEEVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 55160 - protein, 937 aa, Homo sapiens
MEPQVTLNVTFKNEIQSFLVSDPENTTWADIEAMVKVSFDLNTIQIKYLDEENEEVKIVLLGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQGLWGLLSFLHLAKKCFFLKAPSEAFSWF

SEQ ID NO: 55161 - protein, 966 aa, Homo sapiens
MEPQVTLNVTFKNEIQSFLVSDPENTTWADIEAMVKVSFDLNTIQIKYLDEENEEVKIVLLGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 55162 - protein, 966 aa, Homo sapiens; identical to SEQ ID NO: 55159

SEQ ID NO: 55163 - protein, 217 aa, Homo sapiens
MYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGEPRGSSGLVNSRQKSYDHSRHHHGSSIAGGLVKGALSVAASAYKALFAGPPVTAQPIISEDQTAALMAHLFEMGFCDRQLNLRLLKKHNYNILQVVTELLQLNNNDWYSQRY

SEQ ID NO: 55164 - protein, 837 aa, Homo sapiens
MEPQVTLNVTFKNEIQSFLVSDPENTTWADIEAMVSINSQGEYEEALKMAVKQGNQLQMQVHEGHHVVDEAPPPVVGAKRLAARAGKKPLAHYSSLVRVLGSDMKTPEDPAVQSFPLVPCDTDQPQDKPPDWFTSYLETFREQVVNETVEKLEQKLHEKLVLQNPSLGSCPSEVSMPTSEETLFLPENQFSWHIACNNCQRRIVGVRYQCSLCPSYNICEDCEAGPYGHDTNHVLLKLRRPVVGSSEPFCHSKYSTPRLPAALEQVRLQKQVDKNFLKAEKQRLRAEKKQRKAEVKELKKQLKLHRKIHLWNSIHGLQSPKSPLGRPESLLQSNTLMLPLQPCTSVMPMLSAAFVDENLPDGTHLQPGTKFIKHWRMKNTGNVKWSADTKLKFMWGNLTLASTEKKDVLVPCLKAGHVGVVSVEFIAPALEGTYTSHWRLSHKGQQFGPRVWCSIIVDPFPSEESPDNIEKGMISSSKTDDLTCQQEETFLLAKEERQLGEVTEQTEGTAACIPQKAKNVASERELYIPSVDLLTAQDLLSFELLDINIVQELERVPHNTPVDVTPCMSPLPHDSPLIEKPGLGQIEEENEGAGFKALPDSMVSVKRKAENIASVEEAEEDLSGTQFVCETVIRSLTLDAAPDHNPPCRQKSLQMTFALPEGPLGNEKEEIIHIAEEEAVMEEEEDEEDEEEEDELKDEVQSQSSASSEDYIIILPECFDTSRPLGDSMYSSALSQPGLERGAEGKPGVEAGQEPAEAGERLPGGENQPQEHSISDILTTSQTLETVPLIPEVVELPPSLPRSSPCVHHHGSPGVDLPVTIPEVSSVPDQIRGANNF

SEQ ID NO: 55165 - protein, 753 aa, Homo sapiens
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55166 - protein, 810 aa, Homo sapiens
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECSEGIIECHNHSRCVNLPGWYHCECRSGFHDDGTYSLSGESCIDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55167 - protein, 763 aa, Homo sapiens
MPMDLILVVWFCVCTARTVVGFGMDPDLQMDIVTELDLVNTTLGVAQVSGMHNASKAFLFQDIEREIHAAPHVSEKLIQLFRNKSEFTILATVQQKPSTSGVILSIRELEHSYFELESSGLRDEIRYHYIHNGKPRTEALPYRMADGQWHKVALSVSASHLLLHVDCNRIYERVIDPPDTNLPPGINLWLGQRNQKHGLFKGIIQDGKIIFMPNGYITQCPNLNHTCPTCSDFLSLVQGIMDLQELLAKMTAKLNYAETRLSQLENCHCEKTCQVSGLLYRDQDSWVDGDHCRNCTCKSGAVECRRMSCPPLNCSPDSLPVHIAGQCCKVCRPKCIYGGKVLAEGQRILTKSCRECRGGVLVKITEMCPPLNCSEKDHILPENQCCRVCRGHNFCAEGPKCGENSECKNWNTKATCECKSGYISVQGDSAYCEDIDECAAKMHYCHANTVCVNLPGLYRCDCVPGYIRVDDFSCTEHDECGSGQHNCDENAICTNTVQGHSCTCKPGYVGNGTICRAFCEEGCRYGGTCVAPNKCVCPSGFTGSHCEKDIDECALRTHTCWNDSACINLAGGFDCLCPSGPSCSGDCPHEGGLKHNGQVWTLKEDRCSVCSCKDGKIFCRRTACDCQNPSADLFCCPECDTRVTSQCLDQNGHKLYRSGDNWTHSCQQCRCLEGEVDCWPLTCPNLSCEYTAILEGECCPRCVSDPCLADNITYDIRKTCLDSYGVSRLSGSVWTMAGSPCTTCKCKNGRVCCSVDFECLQNN

SEQ ID NO: 55168 - protein, 839 aa, Homo sapiens
MSIRRLLILILKIGRRWTELIRTMESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55169 - protein, 815 aa, Homo sapiens
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55170 - protein, 816 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55171 - protein, 866 aa, Homo sapiens
MGFPPLLKGQASATRSSLASCSWVVFFLSCLSRHAPEIEGGRRWTELIRTMESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCINLPGWYHCECRDGYHDNGMFSPSGESCEDIDECGTGRHSCANDTICFNLDGGYDCRCPHGKNCTGDCIHDGKVKHNGQIWVLENDRCSVCSCQNGFVMCRRMVCDCENPTVDLFCCPECDPRLSSQCLHQNGETLYNSGDTWVQNCQQCRCLQGEVDCWPLPCPDVECEFSILPENECCPRCVTDPCQADTIRNDITKTCLDEMNVVRFTGSSWIKHGTECTLCQCKNGHICCSVDPQCLQEL

SEQ ID NO: 55172 - protein, 816 aa, Homo sapiens; identical to SEQ ID NO: 55170

SEQ ID NO: 55173 - protein, 577 aa, Homo sapiens
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAYVDGKCCKECKSICQFQGRTYFEGERNTVYSSSGVCVLYECKDQTMKLVESSGCPALDCPESHQITLSHSCCKVCKGYDFCSERHNCMENSICRNLNDRAVCSCRDGFRALREDNAYCEDIDECAEGRHYCRENTMCVNTPGSFMCICKTGYIRIDDYSCTEHDECITNQHNCDENALCFNTVGGHNCVCKPGYTGNGTTCKAFCKDGCRNGGACIAANVCACPQGFTGPSCETDIDECSDGFVQCDSRANCICLVPL

SEQ ID NO: 55174 - protein, 110 aa, Homo sapiens
METGLGAPLFKAWLLISVWGLGVDPSLQIDVLTELELGESTTGVRQVPGLHNGTKAFLFQDTPRSIKASTATAEQFFQKLRNKHEFTILVTLKQTHLNSGVILSIHHLDH

SEQ ID NO: 55175 - protein, 815 aa, Homo sapiens; identical to SEQ ID NO: 55169

SEQ ID NO: 55176 - protein, 22 aa, Homo sapiens
MESRVLLRTFCLIFGLGAVWGL

SEQ ID NO: 55177 - protein, 321 aa, Homo sapiens
MESRVLLRTFCLIFGLGAVWGLGVDPSLQIDVLTELELGESTTGVRQVPGLHNGTKAFLFQDTPRSIKASTATAEQFFQKLRNKHEFTILVTLKQTHLNSGVILSIHHLDHRYLELESSGHRNEVRLHYRSGSHRPHTEVFPYILADDKWHKLSLAISASHLILHIDCNKIYERVVEKPSTDLPLGTTFWLGQRNNAHGYFKGIMQDVQLLVMPQGFIAQCPDLNRTCPTCNDFHGLVQKIMELQDILAKTSAKLSRAEQRMNRLDQCYCERTCTMKGTTYREFESWIDGCKNCTCLNGTIQCETLICPNPDCPLKSALAY

SEQ ID NO: 55178 - protein, 1461 aa, Homo sapiens
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55179 - protein, 1461 aa, Homo sapiens; identical to SEQ ID NO: 55178

SEQ ID NO: 55180 - protein, 1172 aa, Homo sapiens
MKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHDVAIPTLPPTSLTSATTDHLAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55181 - protein, 1450 aa, Homo sapiens
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQPVISAHPIHSLDNPHHHFHSSSLASPARSHLYHPGSPWPIGTSMSLSDRANSTESVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55182 - protein, 1408 aa, Homo sapiens
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQPSPLVRVIGQDVVLPCVASGLPTPTIKWMKNEEALDTESSERLVLLAGGSLEISDVTEDDAGTYFCIADNGNETIEAQAELTVQAQPEFLKQPTNIYAHESMDIVFECEVTGKPTPTVKWVKNGDMVIPSDYFKIVKEHNLQVLGLVKSDEGFYQCIAENDVGNAQAGAQLIILEHAPATTGPLPSAPRDVVASLVSTRFIKLTWRTPASDPHGDNLTYSVFYTKEGIARERVENTSHPGEMQVTIQNLMPATVYIFRVMAQNKHGSGESSAPLRVETQPEVQLPGPAPNLRAYAASPTSITVTWETPVSGNGEIQNYKLYYMEKGTDKEQDVDVSSHSYTINGLKKYTEYSFRVVAYNKHGPGVSTPDVAVRTLSDVPSAAPQNLSLEVRNSKSIMIHWQPPAPATQNGQITGYKIRYRKASRKSDVTETLVSGTQLSQLIEGLDRGTEYNFRVAALTINGTGPATDWLSAETFESDLDETRVPEVPSSLHVRPLVTSIVVSWTPPENQNIVVRGYAIGYGIGSPHAQTIKVDYKQRYYTIENLDPSSHYVITLKAFNNVGEGIPLYESAVTRPHTDTSEVDLFVINAPYTPVPDPTPMMPPVGVQASILSHDTIRITWADNSLPKHQKITDSRYYTVRWKTNIPANTKYKNANATTLSYLVTGLKPNTLYEFSVMVTKGRRSSTWSMTAHGTTFELVPTSPPKDVTVVSKEGKPKTIIVNWQPPSEANGKITGYIIYYSTDVNAEIHDWVIEPVVGNRLTHQIQELTLDTPYYFKIQARNSKGMGPMSEAVQFRTPKADSSDKMPNDQASGSGGKGSRLPDLGSDYKPPMSGSNSPHGSPTSPLDSNMLLVIIVSVGVITIVVVVIIAVFCTRRTTSHQKKKRAACKSVNGSHKYKGNSKDVKPPDLWIHHERLELKPIDKSPDPNPIMTDTPIPRNSQDITPVDNSMDSNIHQRRNSYRGHESEDSMSTLAGRRGMRPKMMMPFDSQPPQQSVRNTPSTDTMPASSSQTCCTDHQDPEGATSSSYLASSQEEDSGQSLPTAHVRPSHPLKSFAVPAIPPPGPPTYDPALPSTPLLSQQALNHHIHSVKTASIGTLGRSRPPMPVVVPSAPEVQETTRMLEDSESSYEPDELTKEMAHLEGLMKDLNAITTA

SEQ ID NO: 55183 - protein, 357 aa, Homo sapiens
MQSVQSTSFCLRKQCLCLTFLLLHLLGQVAATQRCPPQCPGRCPATPPTCAPGVRAVLDGCSCCLVCARQRGESCSDLEPCDESSGLYCDRSADPSNQTGICTAVEGDNCVFDGVIYRSGEKFQPSCKFQCTCRDGQIGCVPRCQLDVLLPEPNCPAPRKVEVPGECCEKWICGPDEEDSLGGLTLAAYRPEATLGVEVSDSSVNCIEQTTEWTACSKSCGMGFSTRVTNRNRQCEMLKQTRLCMVRPCEQEPEQPTDKKGKKCLRTKKSLKAIHLQFKNCTSLHTYKPRFCGVCSDGRCCTPHNTKTIQAEFQCSPGQIVKKPVMVIGTCTCHTNCPKNNEAFLQELELKTTRGKM

SEQ ID NO: 55184 - protein, 733 aa, Homo sapiens
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55185 - protein, 614 aa, Homo sapiens
MLARRQRDPLQALRRRNQELKQQVDSLLSESQLKEALEPNKRQHIYQRVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55186 - protein, 732 aa, Homo sapiens
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEAGIFCLVNHVSFCYLIVLMRNRMETVEDTNGSETGFRAWNVQSRGRIFLVSKPVLQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55187 - protein, 677 aa, Homo sapiens
MLARRQRDPLQALRRRNQELKQQVDSLLSESQLKEALEPNKRQHIYQRCIQLKQAIDENKNALQKLSKADESAPVANYNQRKEEEHTLLDKLTQQLQGLAVTISRENITEVGAPTEEEEESESEDSEDSGGEEEDAEEEEEEKEENESHKWSTGEEYIAVGDFTAQQVGDLTFKKGEILLVIEKKPDGWWIAKDAKGNEGLVPRTYLEPYSEEEEGQESSEEGSEEDVEAVDETADGAEVKQRTDPHWSAVQKAISEQINTVDVLTTMGAIPAGFRPSTLSQLLEEGNQFRANYFLQPELMPSQLAFRDLMWDATEGTIRSRPSRISLILTLWSCKMIPLPGMSIQVLSRHVRLCLFDGNKVLSNIHTVRATWQPKKPKTWTFSPQVTRILPCLLDGDCFIRSNSASPDLGILFELGISYIRNSTGERGELSCGWVFLKLFDASGVPIPAKTYELFLNGGTPYEKGIEVDPSISRRAHGSVFYQIMTMRRQPQLLVKLRSLNRRSRNVLSLLPETLIGNMCSIHLLIFYRQILGDVLLKDRMSLQSTDLISHPMLATFPMLLEQPDVMDALRSSWAGKESTLKRSEKRDKEFLKSTFLLVYHDCVLPLLHSTRLPPFRWAEEETETARWKVITDFLKQNQENQGALQALLSPDGVHEPFDLSEQTYDFLGEMRKNAV

SEQ ID NO: 55188 - protein, 704 aa, Homo sapiens
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQALQKTYQKILREKESALEAKYQAMERAATFEHDRDKVKRQFKIFRETKENEIQDLLRAKRELESKLQRLQAQGIQVFDPGESDSDDNCTDVTAAGTQCEYWTGGALGSEPSIGSMIQLQQSFRGPEFAHSSIDVEGPFANVNRDDWDIAVASLLQVTPLFSHSLWSNTVRCYLIYTDETQPEMDLFLKDYSPKLKRMCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQQVEKHMKWLIDPLPVNVRVIVSVNVETCPPAWRLWPTLHLDPLSPKDAKSIIIAECHSVDIKLSKEQCWESRQFR

SEQ ID NO: 55189 - protein, 1330 aa, Homo sapiens
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQALQKTYQKILREKESALEAKYQAMERAATFEHDRDKVKRQFKIFRETKENEIQDLLRAKRELESKLQRLQAQGIQVFDPGESDSDDNCTDVTAAGTQCEYWTGGALGSEPSIGSMIQLQQSFRGPEFAHSSIDVEGPFANVNRDDWDIAVASLLQVTPLFSHSLWSNTVRCYLIYTDETQPEMDLFLKDYSPKLKRMCETMGYFFHAVYFPIDVENQYLTVRKWEIEKSSLVILFIHLTLPSLLLEDCEEAFLKNPEGKPRLIFHRLEDGKVSSDSVQQLIDQVSNLNKTSKAKIIDHSGDPAEGVYKTYICVEKIIKQDILGFENTDLETKDLGSEDSIPEEDDFGDVLWDIHDEQEQMETFQQASNSAHELGFEKYYQRLNDLVAAPAPIPPLLVSGGPGSGKSLLLSKWIQLQQKNSPNTLILSHFVGRPMSTSSESSLIIKRLTLKLMQHSWSVSALTLDPAKLLEEFPRWLEKLSARHQGSIIIVIDSIDQVQQVEKHMKWLIDPLPVNVRVIVSVNVETCPPAWRLWPTLHLDPLSPKDAKSIIIAECHSVDIKLSKEQEKKLERHCRSATTCNALYVTLFGKMIARAGRAGNLDKILHQCFQCQDTLSLYRLVLHSIRESMANDVDKELMKQILCLVNVSHNGVSESELMELYPEMSWTFLTSLIHSLYKMCLLTYGCGLLRFQHLQAWETVRLEYLEGPTVTSSYRQKLINYFTLQLSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLETADQFLKRSLEMRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLSYEGGDFEKAAELYKRAMEIKEAETSLLGGKAPSRHSSSGDTFSLKTAHSPNVFLQQGQR

SEQ ID NO: 55190 - protein, 239 aa, Homo sapiens
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQALQKTYQKILREKESALEAKYQAMERAATFEHDRDKVKRQFKIFRETKENEIQDLLRAKRELESKLQRLQAQGIQVFDPGESDSDDNCTDVTVSLESDQHPGIFIANF

SEQ ID NO: 55191 - protein, 150 aa, Homo sapiens
MGTASSLVSPAGGEVIEDTYGAGGGEACEIPVEVKPKARLLRNSFRRGAGAAAGAGPGSLPRGVGAGGLLGASFKSTGSSVPELEYAAAEYERLRKEYEIFRVSKNQELLSMGRREAKLDTENKRLRAELQGLAAVARSRLTATWNSWAQ

SEQ ID NO: 55192 - protein, 637 aa, Homo sapiens
IIANAGRAGNLDKILHQCFQCQDTLSLYRLVLHSIRESMANDVDKELMKQILCLVNVSHNGVSESELMELYPEMSWTFLTSLIHSLYKMCLLTYGCGLLRFQHLQAWETVRLEYLEGPTVTSSYRQKLINYFTLQLSQDRVTWRSADELPWLFQQQGSKQKLHDCLLNLFVSQNLYKRGHFAELLSYWQFVGKDKSAMATEYFDSLKQYEKNCEGEDNMSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLETADQFLKRSLEMRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLSYEGGDFEKAAELYKRAMEIKEAETSLLGGKAPSRHSSSGDTFSLKTAHSPNVFLQQGQRKVQSNLLSPEGLSNICAQEKTTRFTSS

SEQ ID NO: 55193 - protein, 411 aa, Homo sapiens
MSCLADLYETLGRFLKDLGLLSQAIVPLQRSLEIRETALDPDHPRVAQSLHQLASVYVQWKKFGNAEQLYKQALEISENAYGADHPYTARELEALATLYQKQNKYEQAEHFRKKSFKIHQKAIKKKGNLYGFALLRRRALQLEELTLGKDTPDNARTLNELGVLYYLQNNLETADQFLKRSLEMRERVLGPDHPDCAQSLNNLAALCNEKKQYDKAEELYERALDIRRRALAPDHPSLAYTVKHLAILYKKMGKLDKAVPLYELAVEIRQKSFGPKHPSVATALVNLAVLYSQMKKHVEALPLYERALKIYEDSLGRMHPRVGETLKNLAVLSYEGGDFEKAAELYKRAMEIKEAETSLLGGKAPSRHSSSGDTFSLKTAHSPNVFLQQGQRAGKSNPTFYLQKGFQTYVL

SEQ ID NO: 55194 - protein, 1426 aa, Homo sapiens
MNDWHRIFTQNVLVPPHPQRARQPWKESTAFQCVLKWLDGPVIRQGVLEVLSEVECHLRVSFFDVTYRHFFGRTWKTTVKPTKRPPSRIVFNEPLYFHTSLNHPHIVAVVEVVAEGKKRDGSLQTLSCGFGILRIFSNQPDSPISASQDKRLRLYHGTPRALLHPLLQDPAEQNRHMTLIENCSLQYTLKPHPALEPAFHLLPENLLVSGLQQIPGLLPAHGESGDALRKPRLQKPITGHLDDLFFTLYPSLEKFEEELLELHVQDHFQEGCGPLDGGALEILERRLRVGVHNGLGFVQRPQVVVLVPEMDVALTRSASFSRKVVSSSKTSSGSQALVLRSRLRLPEMVGHPAFAVIFQLEYVFSSPAGVDGNAASVTSLSNLACMHMVRWAVWNPLLEADSGRVTLPLQGGIQPNPSHCLVYKVPSASMSSEEVKQVESGTLRFQFSLGSEEHLDAPTEPVSGPKVERRPSRKPPTSPSSPPAPVPRVLAAPQNSPVGPGLSISQLAASPRSPTQHCLARPTSQLPHGSQASPAQAQEFPLEAGISHLEADLSQTSLVLETSIAEQLQELPFTPLHAPIVVGTQTRSSAGQPSRASMVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKHLLRQGRPAVQASHELEVVATEYEQDNMVVSGDMLGFGRVKPIGVHSVVKGRLHLTLANVGHPCEQKVRGCSTLPPSRSRVISNDGASRFSGGSLLTTGSSRRKHVVQAQKLADVDSELAAMLLTHARQGKGPQDVSRESDATRRRKLERMRSVRLQEAGGDLGRRGTSVLAQQSVRTQHLRDLQVIAAYRERTKAESIASLLSLAITTEHTLHATLGVAEFFEFVLKNPHNTQHTVTVEIDNPELSVIVDSQEWRDFKGAAGLHTPVEEDMFHLRGSLAPQLYLRPHETAHVPFKFQSFSAGQLAMVQASPGLSNEKGMDAVSPWKSSAVPTKHAKVLFRASGGKPIAVLCLTVELQPHVVDQVFRFYHPELSFLKKAIRLPPWHTFPGAPVGMLGEDPPVHVRCSDPNVICETQNVGPGEPRDIFLKVASGPSPEIKDFFVIIYSDRWLATPTQTWQVYLHSLQRVDVSCVAGQLTRLSLVLRGTQTVRKVRAFTSHPQELKTDPKGVFVLPPRGVQDLHVGVRPLRAGSRFVHLNLVDVDCHQLVASWLVCLCCRQPLISKAFEIMLAAGEGKGVNKRITYTNPYPSRRTFHLHSDHPELLRFREDSFQVGGGETYTIGLQFAPSQRVGEEEILIYINDHEDKNEEAFCVKVIYQ

SEQ ID NO: 55195 - protein, 181 aa, Homo sapiens
MVLLQSSGFPEILDANKQPAEAVSATEPVTFNPQKEESDCLQSNEMVLQFLAFSRVAQDCRGTSWPKTVYFTFQFYRFPPATTPRLQLVQLDEAGQPSSGALTHILVPVSRDGTFDAGSPGFQLRYMVGPGFLKPGERRCFARYLAVQTLQIDVWDGDSLLLIGSAAVQMKETSHIFSVSQ

SEQ ID NO: 55196 - protein, 1201 aa, Homo sapiens
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 55197 - protein, 1241 aa, Homo sapiens
MALGTTLRASLLLLGLLTEGLAQLAIPASVPRGFWALPENLTVVEGASVELRCGVSTPGSAVQWAKDGLLLGPDPRIPGFPRYRLEGDPARGEFHLHIEACDLSDDAEYECQVGRSEMGPELVSPRVILSILVPPKLLLLTPEAGTMVTWVAGQEYVVNCVSGDAKPAPDITILLSGQTISDISANVNEGSQQKLFTVEATARVTPRSSDNRQLLVCEASSPALEAPIKASFTVNVLFPPGPPVIEWPGLDEGHVRAGQSLELPCVARGGNPLATLQWLKNGQPVSTAWGTEHTQAVARSVLVMTVRPEDHGAQLSCEAHNSVSAGTQEHGITLQVTFPPSAIIILGSASQTENKNVTLSCVSKSSRPRVLLRWWLGWRQLLPMEETVMDGLHGGHISMSNLTFLARREDNGLTLTCEAFSEAFTKETFKKSLILNVKYPAQKLWIEGPPEGQKLRAGTRVRLVCLAIGGNPEPSLMWYKDSRTVTESRLPQESRRVHLGSVEKSGSTFSRELVLVTGPSDNQAKFTCKAGQLSASTQLAVQFPPTNVTILANASALRPGDALNLTCVSVSSNPPVNLSWDKEGERLEGVAAPPRRAPFKGSAAARSVLLQVSSRDHGQRVTCRAHSAELRETVSSFYRLNVLYRPEFLGEQVLVVTAVEQGEALLPVSVSANPAPEAFNWTFRGYRLSPAGGPRHRILSSGALHLWNVTRADDGLYQLHCQNSEGTAEARLRLDVHYAPTIRALQDPTEVNVGGSVDIVCTVDANPILPGMFNWERLGEDEEDQSLDDMEKISRGPTGRLRIHHAKLAQAGAYQCIVDNGVAPPARRLLRLVVRFAPQVEHPTPLTKVAAAGDSTSSATLHCRARGVPNIVFTWTKNGVPLDLQDPRYTEHTYHQGGVHSSLLTIANVSAAQDYALFTCTATNALGSDQTNIQLVSISRPDPPSGLKVVSLTPHSVGLEWKPGFDGGLPQRFCIRYEALGTPGFHYVDVVPPQATTFTLTGLQPSTRYRVWLLASNALGDSGLADKGTQLPITTPGLHQPSGEPEDQLPTEPPSGPSGLPLLPVLFALGGLLLLSNASCVGGVLWQRRLRRLAEGISEKTEAGSEEDRVRNEYEESQWTGERDTQSSTVSTTEAEPYYRSLRDFSPQLPPTQEEVSYSRGFTGEDEDMAFPGHLYDEVERTYPPSGAWGPLYDEVQMGPWDLHWPEDTYQDPRGIYDQVAGDLDTLEPDSLPFELRGHLV

SEQ ID NO: 55198 - protein, 383 aa, Homo sapiens
MERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEIVTKDMFIMEIDAICYYRMENASLLLSSLAHVSKAVQFLVQTTMKRLLAHRSLTEILLERKSIAQDAKVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 55199 - protein, 315 aa, Homo sapiens
MERRARSSSRESRGRGGRTPHKENKRAKAERSGGGRGRQEAGPEPSGSGRAGTPGEPRAPAATVVDVDEVRGSGEEGTEVVALLESERPEEGTKSSGLGACEWLLVLISLLFIIMTFPFSIWFCVKVVQEYERVIIFRLGHLLPGRAKGPGLFFFLPCLDTYHKVDLRLQTLEIPFHEVALDSVTCIWGIKVERIEIKDVRLPAGLQHSLAVEAEAQRQAKVRMIAAEAEKAASESLRMAAEILSGTPAAVQLRYLHTLQSLSTEKPSTVVLPLPFDLLNCLSSPSNRTQGSLPFPSPSKPVEPLNPKKKDSPML

SEQ ID NO: 55200 - protein, 427 aa, Homo sapiens
MGAGATGRAMDGPRLLLLLLLGVSLGGAKEACPTGLYTHSGECCKACNLGEGVAQPCGANQTVCEPCLDSVTFSDVVSATEPCKPCTECVGLQSMSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 55201 - protein, 333 aa, Homo sapiens
MSAPCVEADDAVCRCAYGYYQDETTGRCEACRVCEAGSGLVFSCQDKQNTVCEECPDGTYSDEANHVDPCLPCTVCEDTERQLRECTRWADAECEEIPGRWITRSTPPEGSDSTAPSTQEPEAPPEQDLIASTVAGVVTTVMGSSQPVVTRGTTDNLIPVYCSILAAVVVGLVAYIAFKRWNSCKQNKQGANSRPVNQTPPPEGEKLHSDSGISVDSQSLHDQQPHTQTASGQALKGDGGLYSSLPPAKREEVEKLLNGSAGDTWRHLAGELGYQPEHIDSFTHEACPVRALLASWATQDSATLDALLAALRRIQRADLVESLCSESTATSPV

SEQ ID NO: 55202 - protein, 111 aa, Homo sapiens
MANIHQENEEMEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 55203 - protein, 101 aa, Homo sapiens
MEQPMQNGEEDRPLGGGEGHQPAGNRRGQARRLAPNFRWAIPNRQINDGMGGDGDDMEIFMEEMREIRRKLRELQLRNCLRILMGELSNHHDHHDEFCLMP

SEQ ID NO: 55204 - protein, 101 aa, Homo sapiens; identical to SEQ ID NO: 55203

SEQ ID NO: 55205 - protein, 111 aa, Homo sapiens; identical to SEQ ID NO: 55202

SEQ ID NO: 55206 - protein, 111 aa, Homo sapiens; identical to SEQ ID NO: 55202

SEQ ID NO: 55207 - protein, 133 aa, Homo sapiens
MMLNSDTMELDLPPTHSETESGFSDCGGGAGPDGAGPGGPGGGQARGPEPGEPGRKDLQHLSREERRRRRRATAKYRTAHATRERIRVEAFNLAFAELRKLLPTLPPDKKLSKIEILRLAICYISYLNHVLDV

SEQ ID NO: 55208 - protein, 135 aa, Homo sapiens
MMLSPDQAADSDHPSSAHSDPESLGGTDTKVLGSVSDLEPVEEAEGDGKGGSRAALYPHPQQLSREEKRRRRRATAKYRSAHATRERIRVEAFNLAFAELRKLLPTLPPDKKLSKIEILRLAICYISYLNHVLDV

SEQ ID NO: 55209 - protein, 135 aa, Homo sapiens; identical to SEQ ID NO: 55208

SEQ ID NO: 55210 - protein, 107 aa, Homo sapiens
MMLSPDQAADSDHPSSAHSDPESLGGTDTKVLGSVSDLEPVEEAEGDGKGGSRAALYPHPQQLSREEKRRRRRATAKYRSAHATRERIRVEAFNLAFAELRKLLPTL

SEQ ID NO: 55211 - protein, 644 aa, Homo sapiens
MTIEIDFLQKKSIDSNPYDTDKMAAEFIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPVTRVLDDGELLVQQTKNSDRTPLVSVLLEGPPHSGKTALAAKIAEESNFPFIKICSPDKMIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIKKLLMLIEMSLQMDPEYRVRKFLALLREEGA

SEQ ID NO: 55212 - protein, 744 aa, Homo sapiens
MAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKGILLYGPPGCGKTLLARQIGKMLNAREPKVVNGPEILNKYVGESEANIRKLFADAEEEQRRLGANSGLHIIIFDEIDAICKQRGSMAGSTGVHDTVVNQLLSKIDGVEQLNNILVIGMTNRPDLIDEALLRPGRLEVKMEIGLPDEKGRLQILHIHTARMRGHQLLSADVDIKELAVETKNFSGAELEGLVRAAQSTAMNRHIKASTKVEVDMEKAESLQVTRGDFLASLENDIKPAFGTNQEDYASYIMNGIIKWGDPVTRVLDDGELLVQQTKNSDRTPLVSVLLEGPPHSGKTALAAKIAEESNFPFIKICSPDKMIGFSETAKCQAMKKIFDDAYKSQLSCVVVDDIERLLDYVPIGPRFSNLVLQALLVLLKKAPPQGRKLLIIGTTSRKDVLQEMEMLNAFSTTIHVPNIATGEQLLEALELLGNFKDKERTTIAQQVKGKKVWIGIKKLLMLIEMSLQMDPEYRVRKFLALLREEGASPLDFD

SEQ ID NO: 55213 - protein, 295 aa, Homo sapiens
MDNSGKEAEAMALLAEAERKVKNSQSFFSGLFGGSSKIEEACEIYARAANMFKMAKNWSAAGNAFCQAAQLHLQLQSKHDAATCFVDAGNAFKKADPQEAINCLMRAIEIYTDMGRFTIAAKHHISIAEIYETELVDIEKAIAHYEQSADYYKGEESNSSANKCLLKVAGYAALLEQYQKAIDIYEQVGTNAMDSPLLKYSAKDYFFKAALCHFCIDMLNAKLAVQKYEELFPAFSDSRECKLMKKLLEAHEEQNVDSYTESVKEYDSISRLDQWLTTMLLRIKKTIQGDEEDLR

SEQ ID NO: 55214 - protein, 298 aa, Homo sapiens
MDNAGKEREAVQLMAEAEKRVKASHSFLRGLFGGNTRIEEACEMYTRAANMFKMAKNWSAAGNAFCQAAKLHMQLQSKHDSATSFVDAGNAYKKADPQEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55215 - protein, 204 aa, Homo sapiens
MTLLPALWMLEMLTKRQIPKGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55216 - protein, 255 aa, Homo sapiens
MYTRAANMFKMAKNWSAAGNAFCQAAKLHMQLQSKHDSATSFVDAGNAYKKADPQEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55217 - protein, 259 aa, Homo sapiens
MDNAGKEREAVQLMAEAEKRVKASHSFLRGLFGGNTRIEEACEMYTRAANMFKMAKNWSEAINCLNAAIDIYTDMGRFTIAAKHHITIAEIYETELVDIEKAIAHYEQSADYYKGEESNSSANKCLLKVAAYAAQLEQYQKAIEIYEQVGANTMDNPLLKYSAKDYFFKAALCHFIVDELNAKLALEKYEEMFPAFTDSRECKLLKKLLEAHEEQNSEAYTEAVKEFDSISRLDQWLTTMLLRIKKSIQGDGEGDGDLK

SEQ ID NO: 55218 - protein, 628 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 55219 - protein, 591 aa, Homo sapiens
MGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSGKCECKEQTLGNAKAFCGMKYSYVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 55220 - protein, 605 aa, Homo sapiens
MGSCARLLLLWGCTVVAAGLSGVAGVSSRCEKACNPRMGNLALGRKLWADTTCGQNATELYCFYSENTDLTCRQPKCDKCNAAYPHLAHLPSAMADSSFRFPRTWWQSAEDVHREKIQLDLEAEFYFTHLIVMFKSPRPAAMVLDRSQDFGKTWKPYKYFATNCSATFGLEDDVVKKGAICTSKYSSPFPCTGGEVIFKALSPPYDTENPYSAKVQEQLKITNLRVQLLKRQSCPCQRNDLNEEPQHFTHYAIYDFIVKGSCFCNGHADQCIPVHGFRPVKAPGTFHMVHGKCMCKHNTAGSHCQHCAPLYNDRPWEAADGKTGAPNECRTCKCNGHADTCHFDVNVWEASGNRSGGVCDDCQHNTEGQYCQRCKPGFYRDLRRPFSAPDACKPCSCHPVGSAVLPANSVTFCDPSNGDCPCKPGVAGRRCDRCMVGYWGFGDYGCRPCDCAGSCDPITGDCISSHTDIDWYHEVPDFRPVHNKSEPAWEWEDAQGFSALLHSVLKIKILSAHDKGTHVEVNVKIKKVLKSTKLKIFRGKRTLYPESWTDRGCTCPILNPGLEYLVAGHEDIRTGKLIVNMKSFVQHWKPSLGRKVMDILKRECK

SEQ ID NO: 55221 - protein, 364 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGSK

SEQ ID NO: 55222 - protein, 505 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 55223 - protein, 286 aa, Homo sapiens
MASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQVAPKLALSTVSSVQVANHKRECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 55224 - protein, 342 aa, Homo sapiens
MASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQVAPKLALSTVSSVQVANHKRDCECFGHSNRCSYIDLLNTVICVSCKHNTRGQHCELCRLGYFRNASAQLDDENVCIECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 55225 - protein, 494 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIANVCDNELLHCQNGGTCHNNVRCLCPAAYTGILCEKLRCEEAGSCGSDSGQGAPPHGSPALLLLTTLLGTASPLVF

SEQ ID NO: 55226 - protein, 480 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQVAPKLALSTVSSVQVANHKRANVCDNELLHCQNGGTCHNNVRCLCPAAYTGILCEKLRCEEAGSCGSDSGQGAPPHGSPALLLLTTLLGTASPLVF

SEQ ID NO: 55227 - protein, 460 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNPPKFNRIWPNISSLEVSNPKQANVCDNELLHCQNGGTCHNNVRCLCPAAYTGILCEKLRCEEAGSCGSDSGQGAPPHGSPALLLLTTLLGTASPLVF

SEQ ID NO: 55228 - protein, 539 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGNCECFGHSNRCSYIDLLNTVICVSCKHNTRGQHCELCRLGYFRNASAQLDDENVCIECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 55229 - protein, 460 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCDPYLTSCGDPPKFNRIWPNISSLEVSNPKQANVCDNELLHCQNGGTCHNNVRCLCPAAYTGILCEKLRCEEAGSCGSDSGQGAPPHGSPALLLLTTLLGTASPLVF

SEQ ID NO: 55230 - protein, 480 aa, Homo sapiens; identical to SEQ ID NO: 55226

SEQ ID NO: 55231 - protein, 494 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCDPYLTSCGDCECFGHSNRCSYIDLLNTVICVSCKHNTRGQHCELCRLGYFRNASAQLDDENVCIANVCDNELLHCQNGGTCHNNVRCLCPAAYTGILCEKLRCEEAGSCGSDSGQGAPPHGSPALLLLTTLLGTASPLVF

SEQ ID NO: 55232 - protein, 539 aa, Homo sapiens; identical to SEQ ID NO: 55228

SEQ ID NO: 55233 - protein, 438 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCIPSISSIGTNVCDNELLHCQNGGTCHNNVRCLCPAAYTGILCEKLRCEEAGSCGSDSGQGAPPHGSPALLLLTTLLGTASPLVF

SEQ ID NO: 55234 - protein, 364 aa, Homo sapiens; identical to SEQ ID NO: 55221

SEQ ID NO: 55235 - protein, 438 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTYLPSMYSVAANVCDNELLHCQNGGTCHNNVRCLCPAAYTGILCEKLRCEEAGSCGSDSGQGAPPHGSPALLLLTTLLGTASPLVF

SEQ ID NO: 55236 - protein, 539 aa, Homo sapiens
MYLSRFLSIHALWVTVSSVMQPYPLVWGHYDLCKTQIYTEEGKVWDYMACQPESTDMTKYLKVKLDPPDITCGDPPETFCAMGNPYMCNNECDASTPELAHPPELMFDFEGRHPSTFWQSATWKEYPKPLQVNITLSWSKTIELTDNIVITFESGRPDQMILEKSLDYGRTWQPYQYYATDCLDAFHMDPKSVKDLSQHTVLEIICTEEYSTGYTTNSKIIHFEIKDRFAFFAGPRLRNMASLYGQLDTTKKLRDFFTVTDLRIRLLRPAVGEIFVDELHLARYFYAISDIKVRGRCKCNLHATVCVYDNSKLTCECEHNTTGPDCGKCKKNYQGRPWSPGSYLPIPKGTANTCDPYLTSCGDCECFGHSNRCSYIDLLNTVICVSCKHNTRGQHCELCRLGYFRNASAQLDDENVCIECYCNPLGSIHDRCNGSGFCECKTGTTGPKCDECLPGNSWHYGCQPNVCDNELLHCQNGGTCHNNVRCLCPAAYTGILCEKLRCEEAGSCGSDSGQGAPPHGSPALLLLTTLLGTASPLVF

SEQ ID NO: 55237 - protein, 172 aa, Homo sapiens
MVGPAPRRRLRPLAALALVLALAPGLPTARAGQTPRPAERGPPVRLFTEEELARYGGEEEDQPIYLAVKGVVFDVTSGKEFYGRGAPYNALTGKDSTRGVAKMSLDPADLTHDTTGLTAKELEALDEVFTKVYKAKYPIVGYTARRILNEDGSPNLDFKPEDQPHFDIKDEF

SEQ ID NO: 55238 - protein, 695 aa, Homo sapiens
MSLLLSFYLLGLLVSSGQDRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 55239 - protein, 837 aa, Homo sapiens
MSLLLSFYLLGLLVSSGQALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIEYAPKFISNQTIYYSWEGNPINISCDVKSNPPASIHWRRDKLVLPAKNTTNLKTYSTGRKMILEIAPTSDNDFGRYNCTATNHIGTRFQEYILALADVPSSPYGVKIIELSQTTAKVSFNKPDSHGGVPIHHYQVDVKEVASEIWKIVRSHGVQTMVVLNNLEPNTTYEIRVAAVNGKGQGDYSKIEIFQTLPVREPSPPSIHGQPSSGKSFKLSITKQDDGGAPILEYIVKYRSKDKEDQWLEKKVQGNKDHIILEHLQWTMGYEVQITAANRLGYSEPTVYEFSMPPKPNIIKDTLFNGLGLGAVIGLGVAALLLILVVTDVSCFFIRQCGLLMCITRRMCGKKSGSSGKSKELEEGKAAYLKDGSKEPIVEMRTEDERVTNHEDGSPVNEPNETTPLTEPEKLPLKEEDGKEALNPETIEIKVSNDIIQSKEDDSKA

SEQ ID NO: 55240 - protein, 424 aa, Homo sapiens
MVRSDSGGQVYLDYHNRQGLFVDWKYNEALYLEEGQPETYYRTALLQVTISLSKVELSVGESKFFTCTAIGEPESIDWYNPQGEKIISTQRVVVQKEGVRSRLTIYNANIEDAGIYRCQATDAKGQTQEATVVLEIYQKLTFREVVSPQEFKQGEDAEVVCRVSSSPAPAVSWLYHNEEVTTISDNRFAMLANNNLQILNINKSDEGIYRCEGRVEARGEIDFRDIIVIVNVPPAISMPQKSFNATAERGEEMTFSCRASGSPEPAISWFRNGKLIEENEKYILKGSNTELTVRNIINSDGGPYVCRATNKAGEDEKQAFLQVFVQPHIIQLKNETTYENGQVTLVCDAEGEPIPEITWKRAVDGFTFTEGDKSLDGRIEVKGQHGSSSLHIKDVKLSDSGRYDCEAASRIGGHQKSMYLDIES

SEQ ID NO: 55241 - protein, 660 aa, Homo sapiens
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 55242 - protein, 571 aa, Homo sapiens
MYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 55243 - protein, 660 aa, Homo sapiens; identical to SEQ ID NO: 55241

SEQ ID NO: 55244 - protein, 571 aa, Homo sapiens; identical to SEQ ID NO: 55242

SEQ ID NO: 55245 - protein, 160 aa, Homo sapiens
MYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADT

SEQ ID NO: 55246 - protein, 167 aa, Homo sapiens
MHFTGAVMQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHG

SEQ ID NO: 55247 - protein, 101 aa, Homo sapiens
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTV

SEQ ID NO: 55248 - protein, 165 aa, Homo sapiens
MQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSV

SEQ ID NO: 55249 - protein, 667 aa, Homo sapiens
MHFTGAVMQENLRFASSGDDIKIWDASSMTLVDKFNPHTSPHGISSICWSSNNNFLVTASSSGDKIVVSSCKCKPVPLLELAEGQKQTCVNLNSTSMYLVSGGLNNTVNIWDLKSKRVHRSLKDHKDQVTCVTYNWNDCYIASGSLSGEIILHSVTTNLSSTPFGHGSNQSVRHLKYSLFKKSLLGSVSDNGIVTLWDVNSQSPYHNFDSVHKAPASGICFSPVNELLFVTIGLDKRIILYDTSSKKLVKTLVADTPLTAVDFMPDGATLAIGSSRGKIYQYDLRMLKSPVKTISAHKTSVQCIAFQYSTVLTKSSLNKGCSNKPTTVNKRSVNVNAASGGVQNSGIVREAPATSIATVLPQPMTSAMGKGTVAVQEKAGLPRSINTDTLSKETDSGKNQDFSSFDDTGKSSLGDMFSPIRDDAVVNKGSDESIGKGDGFDFLPQLNSVFPPRKNPVTSSTSVLHSSPLNVFMGSPGKEENENRDLTAESKKIYMGKQESKDSFKQLAKLVTSGAESGNLNTSPSSNQTRNSEKFEKPENEIEAQLICEPPINGSSTPNPKIASSVTAGVASSLSEKIADSIGNNRQNAPLTSIQIRFIQNMIQETLDDFREACHRDIVNLQVEMIKQFHMQLNEMHSLLERYSVNEGLVAEIERLREENKRLRAHF

SEQ ID NO: 55250 - protein, 1247 aa, Homo sapiens
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 55251 - protein, 900 aa, Homo sapiens
MATCAVEVFGLLEDEENSRIVRVRVIAGIGLAKKDILGASDPYVRVTLYDPMNGVLTSVQTKTIKKSLNPKWNEEILFRVHPQQHRLLFEVFDENRLTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 55252 - protein, 1303 aa, Homo sapiens
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTRDDFLGQVDVPLYPLPTENPRLERPYTFKDFVLHPRSHKSRVKGYLRLKMTYLPKTSGSEDDNAEQAEELEQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 55253 - protein, 1319 aa, Homo sapiens
MAQSLRLHFAARRSNTYPLSETSGDDLDSHVHMCFKRPTRISTSNVVQMKLTPRQTALAPLIKENVQSQERSSVPSSENVNKKSSCLQISLQPTRYSGYLQSSNVLADSDDASFTCILKDGIYSSAVVDNELNAVNDGHLVSSPAICSGSLSNFSTSDNGSYSSNGSDFGSCASITSGGSYTNSVISDSSSYTFPPSDDTFLGGNLPSDSTSNRSVPNRNTTPCEIFSRSTSTDPFVQDDLEHGLEIMKLPVSRNTKIPLKRYSSLVIFPRSPSTTRPTSPTSLCTLLSKGSYQTSHQFIISPSEIAHNEDGTSAKGFLSTAVNGLRLSKTICTPGEVRDIRPLHRKGSLQKKIVLSNNTPRQTVCEKSSEGYSCVSVHFTQRKAATLDCETTNGDCKPEMSEIKLNSDSEYIKLMHRTSACLPSSQNVDCQININGELERPHSQMNKNHGILRRSISLGGAYPNISCLSSLKHNCSKGGPSQLLIKFASGNEGKVDNLSRDSNRDCTNELSNSCKTRDDFLGQVDVPLYPLPTENPRLERPYTFKDFVLHPRSHKSRVKGYLRLKMTYLPKTSGSEDDNAEQAEELEPGWVVLDQPDAACHLQQQQEPSPLPPGWEERQDILGRTYYVNHESRRTQWKRPTPQDNLTDAENGNIQLQAQRAFTTRRQISEETESVDNRESSENWEIIREDEATMYSNQAFPSPPPSSNLDVPTHLAEELNARLTIFGNSAVSQPASSSNHSSRRGSLQAYTFEEQPTLPVLLPTSSGLPPGWEEKQDERGRSYYVDHNSRTTTWTKPTVQATVETSQLTSSQSSAGPQSQASTSDSGQQVTQPSEIEQGFLPKGWEVRHAPNGRPFFIDHNTKTTTWEDPRLKIPAHLRGKTSLDTSNDLGPLPPGWEERTHTDGRIFYINHNIKRTQWEDPRLENVAITGPAVPYSRDYKRKYEFFRRKLKKQNDIPNKFEMKLRRATVLEDSYRRIMGVKRADFLKARLWIEFDGEKGLDYGGVAREWFFLISKEMFNPYYGLFEYSATDNYTLQINPNSGLCNEDHLSYFKFIGRVAGMAVYHGKLLDGFFIRPFYKMMLHKPITLHDMESVDSEYYNSLRWILENDPTELDLRFIIDEELFGQTHQHELKNGGSEIVVTNKNKKEYIYLVIQWRFVNRIQKQMAAFKEGFFELIPQDLIKIFDENELELLMCGLGDVDVNDWREHTKYKNGYSANHQVIQWFWKAVLMMDSEKRIRLLQFVTGTSRVPMNGFAELYGSNGPQSFTVEQWGTPEKLPRAHTCFNRLDLPPYESFEELWDKLQMAIENTQGFDGVD

SEQ ID NO: 55254 - protein, 871 aa, Homo sapiens
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55255 - protein, 835 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPKAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55256 - protein, 911 aa, Homo sapiens
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55257 - protein, 967 aa, Homo sapiens
MRRLAFEQGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55258 - protein, 955 aa, Homo sapiens
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55259 - protein, 975 aa, Homo sapiens
MATGLGEPVYGLSEDEGESRILRVKVVSGIDLAKKDIFGASDPYVKLSLYVADENRELALVQTKTIKKTLNPKWNEEFYFRVNPSNHRLLFEVFDENRLTRDDFLGQVDVPLSHLPTEDPTMERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55260 - protein, 854 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSAPAGRARSSTVTGGEEPTPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55261 - protein, 834 aa, Homo sapiens
MERPYTFKDFLLRPRSHKSRVKGFLRLKMAYMPKNGGQDEENSDQRDDMEHGWEVVDSNDSASQHQEELPPPPLPPGWEEKVDNLGRTYYVNHNNRTTQWHRPSLMDVSSESDNNIRQINQEAAHRRFRSRRHISEDLEPEPSEGGDVPEPWETISEEVNIAGDSLGLALPPPPASPGSRTSPQELSEELSRRLQITPDSNGEQFSSLIQREPSSRLRSCSVTDAVAEQGHLPPPSVAYVHTTPGLPSGWEERKDAKGRTYYVNHNNRTTTWTRPIMQLAEDGASGSATNSNNHLIEPQIRRPRSLSSPTVTLSAPLEGAKDSPVRRAVKDTLSNPQSPQPSPYNSPKPQHKVTQSFLPPGWEMRIAPNGRPFFIDHNTKTTTWEDPRLKFPVHMRSKTSLNPNDLGPLPPGWEERIHLDGRTFYIDHNSKITQWEDPRLQNPAITGPAVPYSREFKQKYDYFRKKLKKPADIPNRFEMKLHRNNIFEESYRRIMSVKRPDVLKARLWIEFESEKGLDYGGVAREWFFLLSKEMFNPYYGLFEYSATDNYTLQINPNSGLCNEDHLSYFTFIGRVAGLAVFHGKLLDGFFIRPFYKMMLGKQITLNDMESVDSEYYNSLKWILENDPTELDLMFCIDEENFGQTYQVDLKPNGSEIMVTNENKREYIDLVIQWRFVNRVQKQMNAFLEGFTELLPIDLIKIFDENELELLMCGLGDVDVNDWRQHSIYKNGYCPNHPVIQWFWKAVLLMDAEKRIRLLQFVTGTSRVPMNGFAELYGSNGPQLFTIEQWGSPEKLPRAHTCFNRLDLPPYETFEDLREKLLMAVENAQGFEGVD

SEQ ID NO: 55262 - protein, 834 aa, Homo sapiens; identical to SEQ ID NO: 55261

SEQ ID NO: 55263 - protein, 854 aa, Homo sapiens; identical to SEQ ID NO: 55260

SEQ ID NO: 55264 - protein, 174 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVFQRDGQVSYFLVRASKQTSL

SEQ ID NO: 55265 - protein, 834 aa, Homo sapiens
MKYKNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 55266 - protein, 32 aa, Homo sapiens
MWTRNLMARALYDNVPECAEELAFRKGDILTV

SEQ ID NO: 55267 - protein, 834 aa, Homo sapiens
MWTRNLMARALYDNVPECAEELAFRKGDILTVIEQNTGGLEGWWLCSLHGRQGIVPGNRVKLLIGPMQETASSHEQPASGLMQQTFGQQKLYQVPNPQAAPRDTIYQVPPSYQNQGIYQVPTGHGTQEQEVYQVPPSVQRSIGGTSGPHVGKKVITPVRTGHGYVYEYPSRYQKDVYDIPPSHTTQGVYDIPPSSAKGPVFSVPVGEIKPQGVYDIPPTKGVYAIPPSACRDEAGLREKDYDFPPPMRQAGRPDLRPEGVYDIPPTCTKPAGKDLHVKYNCDIPGAAEPVARRHQSLSPNHPPPQLGQSVGSQNDAYDVPRGVQFLEPPAETSEKANPQERDGVYDVPLHNPPDAKGSRDLVDGINRLSFSSTGSTRSNMSTSSTSSKESSLSASPAQDKRLFLDPDTAIERLQRLQQALEMGVSSLMALVTTDWRCYGYMERHINEIRTAVDKVELFLKEYLHFVKGAVANAACLPELILHNKMKRELQRVEDSHQILSQTSHDLNECSWSLNILAINKPQNKCDDLDRFVMVAKTVPDDAKQLTTTINTNAEALFRPGPGSLHLKNGPESIMNSTEYPHGGSQGQLLHPGDHKAQAHNKALPPGLSKEQAPDCSSSDGSERSWMDDYDYVHLQGKEEFERQQKELLEKENIMKQNKMQLEHHQLSQFQLLEQEITKPVENDISKWKPSQSLPTTNSGVSAQDRQLLCFYYDQCETHFISLLNAIDALFSCVSSAQPPRIFVAHSKFVILSAHKLVFIGDTLTRQVTAQDIRNKVMNSSNQLCEQLKTIVMATKMAALHYPSTTALQEMVHQVTDLSRNAQLFKRSLLEMATF

SEQ ID NO: 55268 - protein, 403 aa, Homo sapiens
MLRPEAGLVGLHGPAQENSALPGRRDSASELRALSGLEVDPGEGWGRVVLISPRTVRFRVLSPGVREEGHVQNNGQNQARPARGVTGAGGWGSAAVCRGRALRGREPALPSASFPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGLPSTPGTPTPTPHTSLGSPVSSDPVHMSPLEPRGGQGDGLALVLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 55269 - protein, 325 aa, Homo sapiens
MATPLPPPSPRHLRLLRLLLSGLVLGAALRGAAAGHPDVAACPGSLDCALKRRARCPPGAHACGPCLQPFQEDQQGLCVPRMRRPPGGGRPQPRLEDEIDFLAQELARKESGHSTPPLPKDRQRLPEPATLGFSARGQGLELGLPSTPGTPTPTPHTSLGSPVSSDPVHMSPLEPRGGQGDGLALVLILAFCVAGAAALSVASLCWCRLQREIRLTQKADYATAKAPGSPAAPRISPGDQRLAQSAEMYHYQHQRQQMLCLERHKEPPKELDTASSDEENEDGDFTVYECPGLAPTGEMEVRNPLFDHAALSAPLPAPSSPPALP

SEQ ID NO: 55270 - protein, 98 aa, Homo sapiens
MSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 55271 - protein, 237 aa, Homo sapiens
MALPPSPLAMEYVNDFDLMKFEVKREPSEGRPGPPTASLGSTPYSSVPPSPTFSEPGMVGATEGTRPGLEELYWLATLQQQLGAGEALGLSPEEAMELLQGQGPVPVDGPHGYYPGSPEETGAQHVQLAERFSDAALVSMSVRELNRQLRGCGRDEALRLKQRRRTLKNRGYAQACRSKRLQQRRGLEAERARLAAQLDALRAEVARLARERDLYKARCDRLTSSGPGSGDPSHLFL

SEQ ID NO: 55272 - protein, 237 aa, Homo sapiens; identical to SEQ ID NO: 55271

SEQ ID NO: 55273 - protein, 65 aa, Homo sapiens
MALPPSPLAMEYVNDFDLMKFEVKREPSEGRPGPPTASLGSTPYSSVPPSPTFSEPGMVGATEGT

SEQ ID NO: 55274 - protein, 98 aa, Homo sapiens; identical to SEQ ID NO: 55270

SEQ ID NO: 55275 - protein, 237 aa, Homo sapiens; identical to SEQ ID NO: 55271

SEQ ID NO: 55276 - protein, 557 aa, Homo sapiens
MGGQITRSTLHDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLDSELVLPDCLRPRSFTALRRPSLRREADDARLSVSLCDLNVPGADGDEAAPAAGCPIPQNSLNSQHSRALPAQLDGDLRFHALRAGAHVRILDEQTVARVEHGRDERALVFTSRPVRVAETIFVKVTRSGGARPGALSFGVTTCDPGTLRPADLPFSPEALVDRKEFWAVCRVPGPLHSGDILGLVVNADGELHLSHNGAAAGMQLCVDASQPLWMLFGLHGTITQIRILGSTILAERGIPSLPCSPASTPTSPSALGSRLSDPLLSTCSSGPLGSSAGGTAPNSPVSLPESPVTPGLGQWSDECTICYEHAVDTVIYTCGHMCLCYACGLRLKKALHACCPICRRPIKDIIKTYRSS

SEQ ID NO: 55277 - protein, 574 aa, Homo sapiens
MGNNFSSIPSLPRGNPSRAPRGHPQNLKDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLLDSELVLPDCLRPRSFTALRRPSLRREADDARLSVSLCDLNVPGADGDEAAPAAGCPIPQNSLNSQHSRALPAQLDGDLRFHALRAGAHVRILDEQTVARVEHGRDERALVFTSRPVRVAETIFVKVTRSGGARPGALSFGVTTCDPGTLRPADLPFSPEALVDRKEFWAVCRVPGPLHSGDILGLVVNADGELHLSHNGAAAGMQLCVDASQPLWMLFGLHGTITQIRILGSTILAERGIPSLPCSPASTPTSPSALGSRLSDPLLSTCSSGPLGSSAGGTAPNSPVSLPESPVTPGLGQWSDECTICYEHAVDTVIYTCGHMCLCYACGLRLKKALHACCPICRRPIKDIIKTYRSS

SEQ ID NO: 55278 - protein, 199 aa, Homo sapiens
MGGQITRSTLHDSIGGPFPVTSHRCHHKQKHCPAVLPSGGLPATPLLFHPHTKGSQILMDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRINDSAVMLFFSGVRTADPLWALVDVYGLTRGVQLL

SEQ ID NO: 55279 - protein, 108 aa, Homo sapiens
MDLSHKAVKRQASFCNAITFSNRPVLIYEQVRLKITKKQCCWSGALRLGFTSKDPSRIHPDSLPKYACPDLVSQSGFWAKALPEEFANEGNIIAFWVDKKGRVFHRIN

SEQ ID NO: 55280 - protein, 850 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 55281 - protein, 426 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQSVLWDTPGTGVSSSQWSTSPKPRSCTRRGS

SEQ ID NO: 55282 - protein, 858 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQSFLSFELSKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 55283 - protein, 784 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 55284 - protein, 330 aa, Homo sapiens
MRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQSVLWDTPGTGVSSSQWSTSPSTLDLN

SEQ ID NO: 55285 - protein, 852 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSTRLGGDVEEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 55286 - protein, 844 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPVGYTGDRCQQFAMVNFSKAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 55287 - protein, 858 aa, Homo sapiens
MRQVCCSALPPPPLEKGRCSSYSDSSSSSSERSSSSSSSSSESGSSSRSSSNNSSISRPAAPPEPRPQQQPQPRSPAARRAAARSRAAAAGGMRRDPAPGFSMLLFGVSLACYSPSLKSVQDQAYKAPVVVEGKVQGLVPAGGSSSNSTREPPASGRVALVKVLDKWPLRSGGLQREQVISVGSCVPLERNQRYIFFLEPTEQPLVFKTAFAPLDTNGKNLKKEVGKILCTDCATRPKLKKMKSQTGQVGEKQSLKCEAAAGNPQPSYRWFKDGKELNRSRDIRIKYGNGRKNSRLQFNKVKVEDAGEYVCEAENILGKDTVRGRLYVNSVSTTLSSWSGHARKCNETAKSYCVNGGVCYYIEGINQLSCKCPNGFFGQRCLEKLPLRLYMPDPKQKHLGFELKEAEELYQKRVLTITGICVALLVVGIVCVVAYCKTKKQRKQMHNHLRQNMCPAHQNRSLANGPSHPRLDPEEIQMADYISKNVPATDHVIRRETETTFSGSHSCSPSHHCSTATPTSSHRHESHTWSLERSESLTSDSQSGIMLSSVGTSKCNSPACVEARARRAAAYNLEERRRATAPPYHDSVDSLRDSPHSERYVSALTTPARLSPVDFHYSLATQVPTFEITSPNSAHAVSLPPAAPISYRLAEQQPLLRHPAPPGPGPGPGPGPGPGADMQRSYDSYYYPAAGPGPRRGTCALGGSLGSLPASPFRIPEDDEYETTQECAPPPPPRPRARGASRRTSAGPRRWRRSRLNGLAAQRARAARDSLSLSSGSGGGSASASDDDADDADGALAAESTPFLGLRGAHDALRSDSPPLCPAADSRTYYSLDSHSTRASSRHSRGPPPRAKQDSAPL

SEQ ID NO: 55288 - protein, 696 aa, Homo sapiens
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 55289 - protein, 499 aa, Homo sapiens
MECGIPPTLVCVGRGGGLHTINIIIWYYFPSAWRTCFNISSSVGLLLTNSYKFYTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGIEVRKTISHLPIQLWCVERPLDLKYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 55290 - protein, 720 aa, Homo sapiens
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTDHLGIEFMESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGIEVRKTISHLPIQLWCVERPLDLKYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 55291 - protein, 695 aa, Homo sapiens
MSEGAAAASPPGAASAAAASAEEGTAAAAAAAAAGGGPDGGGEGAAEPPRELRCSDCIVWNRQQTWLCVVPLFIGFIGLGLSLMLLKWIVVGSVKEYVPTDLVDSKGMGQDPFFLSKPSSFPKAMETTTTTTSTTSPATPSAGGAASSRTPNRISTRLTTITRAPTRFPGHRVPIRASPRSTTARNTAAPATVPSTTAPFFSSSTLGSRPPVPGTPSTQAMPSWPTAAYATSSYLHDSTPSWTLSPFQDAASSSSSSSSSATTTTPETSTSPKFHTTTYSTERSEHFKPCRDKDLAYCLNDGECFVIETLTGSHKHCRCKEGYQGVRCDQFLPKTDSILSDPTHIGIIFTESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 55292 - protein, 346 aa, Homo sapiens
MESEEVYQRQVLSISCIIFGIVIVGMFCAAFYFKSKKQAKQIQEQLKVPQNGKSYSLKASSTMAKSENLVKSHVQLQNYSKVERHPVTALEKMMESSFVGPQSFPEVPSPDRGSQSVKHHRSLSSCCSPGQRSGMLHRNAFRRTPPSPRSRLGGIVGPAYQQLEESRIPDQDTIPCQGYSSSGLKTQRNTSINMQLPSRETNPYFNSLEQKDLVGYSSTRASSVPIIPSVGLEETCLQMPGISEVKSIKWCKNSYSADVVNVSIPVSDCLIAEQQEVKILLETVQEQIRILTDARRSEDYELASVETEDSASENTAFLPLSPTAKSEREAQFVLRNEIQRDSALTK

SEQ ID NO: 55293 - protein, 346 aa, Homo sapiens; identical to SEQ ID NO: 55292

SEQ ID NO: 55294 - protein, 56 aa, Homo sapiens
MPTDHEEPCGPSHKSFCLNGGLCYVIPTIPSPFCSLHENENDNNEDLYDDLLPLNE

SEQ ID NO: 55295 - protein, 115 aa, Homo sapiens
MPTDHEEPCGPSHKSFCLNGGLCYVIPTIPSPFCRCVENYTGARCEEVFLPGSSIQTKSNLFEAFVALAVLVTLIIGAFYFLCRKGHFQRASSVQYDINLVETSSTSAHHSHEQH

SEQ ID NO: 55296 - protein, 90 aa, Homo sapiens
MPTDHEEPCGPSHKSFCLNGGLCYVIPTIPSPFCRCVENYTGARCEEVFLPGSSIQTKSNLFEAFVALAVLVTLIIGAFYFLCRCGNTCM

SEQ ID NO: 55297 - protein, 204 aa, Homo sapiens
MMPSCNRSCSCSRGPSVEDGKWYGVRSYLHLFYEDCAGTALSDDPEGPPVLCPRRPWPSLCWKISLSSGTLLLLLGVAALTTGYAVPPKLEGIGEGEFLVLDQRAADYNQALGTCRLAGTALCVAAGVLLAICLFWAMIGWLSQDTKAEPLDPEADSHVEVFGDEPEQQLSPIFRNASGQSWFSPPASPFGQSSVQTIQPKRDS

SEQ ID NO: 55298 - protein, 204 aa, Homo sapiens; identical to SEQ ID NO: 55297

SEQ ID NO: 55299 - protein, 442 aa, Homo sapiens
MYQRMLRCGAELGSPGGGGGGGGGGGAGGRLALLWIVPLTLSGLLGVAWGASSLGAHHIHHFHGSSKHHSVPIAIYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55300 - protein, 1507 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55301 - protein, 495 aa, Homo sapiens
MISRDTSNLHTVKIDTKITTQITAGARNLDLKSDLYIGGVAKETYKSLPKLVHAKEGFQGCLASVDLNGRLPDLISDALFCNGQIERGCEVALMKADLQGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55302 - protein, 1499 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQADTNLEGLAHLMMGDQAKSKRKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55303 - protein, 1547 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55304 - protein, 1477 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEDNNVEGLAHLMMGDQGKSKGKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55305 - protein, 1477 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQADTNLEGLAHLMMGDQAKSKRKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55306 - protein, 1548 aa, Homo sapiens
MGTALLQRGGCFLLCLSLLLLGCWAELGSGLEFPGAEGQWTRFPKWNACCESEMSFQLKTRSARGLVLYFDDEGFCDFLELILTRGGRLQLSFSIFCAEPATLLADTPVNDGAWHSVRIRRQFRNTTLFIDQVEAKWVEVKSKRRDMTVFSGLFVGGLPPELRAAALKLTLASVREREPFKGWIRDVRVNSSQVLPVDSGEVKLDDEPPNSGGGSPCEAGEEGEGGVCLNGGVCSVVDDQAVCDCSRTGFRGKDCSQEIKFGLQCVLPVLLHDNDQGKYCCINTAKPLTEKKDNDFEGLAHLMMGDQAKSKRKEEYIATFKGSEYFCYDLSQNPIQSSSDEITLSFKTLQRNGLMLHTGKSADYVNLALKNGAVSLVINLGSGAFEALVEPVNGKFNDNAWHDVKVTRNLRQHSGIGHAMVNKLHCSVTISVDGILTTTGYTQEDYTMLGSDDFFYVGGSPSTADLPGSPVSNNFMGCLKEVVYKNNDVRLELSRLAKQGDPKMKIHGVVAFKCENVATLDPITFETPESFISLPKWNAKKTGSISFDFRTTEPNGLILFSHGKPRHQKDAKHPQMIKVDFFAIEMLDGHLYLLLDMGSGTIKIKALLKKVNDGEWYHVDFQRDGRSGTISVNTLRTPYTAPGESEILDLDDELYLGGLPENKAGLVFPTEVWTALLNYGYVGCIRDLFIDGQSKDIRQMAEVQSTAGVKPSCSKETAKPCLSNPCKNNGMCRDGWNRYVCDCSGTGYLGRSCEREATVLSYDGSMFMKIQLPVVMHTEAEDVSLRFRSQRAYGILMATTSRDSADTLRLELDAGRVKLTVNLDCIRINCNSSKGPETLFAGYNLNDNEWHTVRVVRRGKSLKLTVDDQQAMTGQMAGDHTRLEFHNIETGIITERRYLSSVPSNFIGHLQSLTFNGMAYIDLCKNGDIDYCELNARFGFRNIIADPVTFKTKSSYVALATLQAYTSMHLFFQFKTTSLDGLILYNSGDGNDFIVVELVKGYLHYVFDLGNGANLIKGSSNKPLNDNQWHNVMISRDTSNLHTVKIDTKITTQITAGARNLDLKSDLYIGGVAKETYKSLPKLVHAKEGFQGCLASVDLNGRLPDLISDALFCNGQIERGCEGPSTTCQEDSCSNQGVCLQQWDGFSCDCSMTSFSGPLCNDPGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGNNDNERLAIARQRIPYRLGRVVDEWLLDKGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55307 - protein, 396 aa, Homo sapiens
ALEIWEQPPAPRLLFPGLPFRTSPSPAAFYRSPASLRGGHAGTTYIFSKGGGQITYKWPPNDRPSTRADRLAIGFSTVQKEAVLVRVDSSSGLGDYLELHIHQGKIGVKFNVGTDDIAIEESNAIINDGKYHVVRFTRSGGNATLQVDSWPVIERYPAGRQLTIFNSQATIIIGGKEQGQPFQGQLSGLYYNGLKVLNMAAENDANIAIVGNVRLVGEVPSSMTTESTATAMQSEMSTSIMETTTTLATSTARRGKPPTKEPISQTTDDILVASAECPSDDEDIDPCEPSSGGLANPTRAGGREPYPGSAEVIRESSSTTGMVVGIVAAAALCILILLYAMYKYRNRDEGSYHVDESRNYISNSAQSNGAVVKEKQPSSAKSSNKNKKNKDKEYYV

SEQ ID NO: 55308 - protein, 1712 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVNKLHYLVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 55309 - protein, 1642 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEAPSPFQGPAHLTLNSEGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLGKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 55310 - protein, 1712 aa, Homo sapiens; identical to SEQ ID NO: 55308

SEQ ID NO: 55311 - protein, 1642 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLGKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 55312 - protein, 1705 aa, Homo sapiens
MASGSRWRPTPPPLLLLLLLALAARADGLEFGGGPGQWARYARWAGAASSGELSFSLRTNATRALLLYLDDGGDCDFLELLLVDGRLRLRFTLSCAEPATLQLDTPVADDRWHMVLLTRDARRTALAVDGEARAAEVRSKRREMQVASDLFVGGIPPDVRLSALTLSTVKYEPPFRGLLANLKLGERPPALLGSQGLRGATADPLCAPARNPCANGGLCTVLAPGEVGCDCSHTGFGGKFCSEEEHPMEGPAHLTLNSEVGSLLFSEGGAGRGGAGDVHQPTKGKEEFVATFKGNEFFCYDLSHNPIQSSTDEITLAFRTLQRNGLMLHTGKSADYVNLSLKSGAVWLVINLGSGAFEALVEPVNGKFNDNAWHDVRVTRNLRQHAGIGHAMVTISVDGILTTTGYTQEDYTMLGSDDFFYIGGSPNTADLPGSPVSNNFMGCLKDVVYKNNDFKLELSRLAKEGDPKMKLQGDLSFRCEDVAALDPVTFESPEAFVALPRWSAKRTGSISLDFRTTEPNGLLLFSQGRRAGGGAGSHSSAQRADYFAMELLDGHLYLLLDMGSGGIKLRASSRKVNDGEWCHVDFQRDGRKGSISVNSRSTPFLATGDSEILDLESELYLGGLPEGGRVDLPLPPEVWTAALRAGYVGCVRDLFIDGRSRDLRGLAEAQGAVGVAPFCSRETLKQCASAPCRNGGVCREGWNRFICDCIGTGFLGRVCEREATVLSYDGSMYMKIMLPNAMHTEAEDVSLRFMSQRAYGLMMATTSRESADTLRLELDGGQMKLTVNLDCLRVGCAPSKGPETLFAGHKLNDNEWHTVRVVRRGKSLQLSVDNVTVEGQMAGAHMRLEFHNIETGIMTERRFISVVPSNFIGHLSGLVFNGQPYMDQCKDGDITYCELNARFGLRAIVADPVTFKSRSSYLALATLQAYASMHLFFQFKTTAPDGLLLFNSGNGNDFIVIELVKGYIHYVFDLGNGPSLMKGNSDKPVNDNQWHNVVVSRDPGNVHTLKIDSRTVTQHSNGARNLDLKGELYIGGLSKNMFSNLPKLVASRDGFQGCLASVDLNGRLPDLIADALHRIGQVERGCDGPSTTCTEESCANQGVCLQQWDGFTCDCTMTSYGGPVCNDPGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 55313 - protein, 666 aa, Homo sapiens
MPPGGSGPGGCPRRPPALAGPLPPPPPPPPPPLLPLLPLLLLLLLGAAEGARVSSSLSTTHHVHHFHSKHGTVPIAINRMPFLTRGGHAGTTYIFGKGGALITYTWPPNDRPSTRMDRLAVGFSTHQRSAVLVRVDSASGLGDYLQLHIDQGTVGVIFNVGTDDITIDEPNAIVSDGKYHVVRFTRSGGNATLQVDSWPVNERYPAGNFDNERLAIARQRIPYRLGRVVDEWLLDKGRQLTIFNSQAAIKIGGRDQGRPFQGQVSGLYYNGLKVLALAAESDPNVRTEGHLRLVGEGPSVLLSAETTATTLLADMATTIMETTTTMATTTTRRGRSPTLRDSTTQNTDDLLVASAECPSDDEDLEECEPSTGGELILPIITEDSLDPPPVATRSPFVPPPPTFYPFLTGVGATQDTLPPPAARRPPSGGPCQAERDDSDCEEPIEASGFASGEVFDSSLPPTDDEDFYTTFPLVTDRTTLLSPRKPAPRPNLRTDGATGAPGVLFAPSAPAPNLPAGKMNHRDPLQPLLENPPLGPGAPTSFEPRRPPPLRPGVTSAPGFPHLPTANPTGPGERGPPGAVEVIRESSSTTGMVVGIVAAAALCILILLYAMYKYRNRDEGSYQVDQSRNYISNSAQSNGAVVKEKAPAAPKTPSKAKKNKDKEYYV

SEQ ID NO: 55314 - protein, 432 aa, Homo sapiens
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 55315 - protein, 1643 aa, Homo sapiens
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGSSGDPCLSHLMMSEQAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTARGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 55316 - protein, 1392 aa, Homo sapiens
MSSTLHSVFFTLKVSILLGSLLGLCLGLEFMGLPNQWARYLRWDASTRSDLSFQFKTNVSTGLLLYLDDGGVCDFLCLSLVDGRVQLRFSMDCAETAVLSNKQVNDSSWHFLMVSRDRLRTVLMLDGEGQSGELQPQRPYMDVVSDLFLGGVPTDIRPSALTLDGVQAMPGFKGLILDLKYGNSEPRLLGSRGVQMDAEGPCGERPCENGGICFLLDGHPTCDCSTTGYGGKLCSEGLSHLMMSEQGRWKAREENVATFRGSEYLCYDLSQNPIQSSSDEITLSFKTWQRNGLILHTGKSADYVNLALKDGAVSLVINLGSGAFEAIVEPVNGKFNDNAWHDVKVTRNLRQVTISVDGILTTTGYTQEDYTMLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLGKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGRSARSSNAARSLRAALTWTWRLTYTFTPIIFISCVVHS

SEQ ID NO: 55317 - protein, 1061 aa, Homo sapiens
MLGSDDFFYVGGSPSTADLPGSPVSNNFMGCLKEVVYKNNDIRLELSRLARIADTKMKIYGEVVFKCENVATLDPINFETPEAYISLPKWNTKRMGSISFDFRTTEPNGLILFTHGKPQERKDARSQKNTKVDFFAVELLDGNLYLLLDMGSGTIKVKATQKKANDGEWYHVDIQRDGRSGTISVNSRRTPFTASGESEILDLEGDMYLGGLPENRAGLILPTELWTAMLNYGYVGCIRDLFIDGRSKNIRQLAEMQNAAGVKSSCSRMSAKQCDSYPCKNNAVCKDGWNRFICDCTGTGYWGRTCEREASILSYDGSMYMKIIMPMVMHTEAEDVSFRFMSQRAYGLLVATTSRDSADTLRLELDGGRVKLMVNLDCIRINCNSSKGPETLYAGQKLNDNEWHTVRVVRRGKSLKLTVDDDVAEGTMVGDHTRLEFHNIETGIMTEKRYISVVPSSFIGHLQSLMFNGLLYIDLCKNGDIDYCELKARFGLRNIIADPVTFKTKSSYLSLATLQAYTSMHLFFQFKTTSPDGFILFNSGDGNDFIAVELVKGYIHYVFDLGNGPNVIKGNSDRPLNDNQWHNVVITRDNSNTHSLKVDTKVVTQVINGAKNLDLKGDLYMAGLAQGMYSNLPKLVASRDGFQGCLASVDLNGRLPDLINDALHRSGQIERGCEGPSTTCQEDSCANQGVCMQQWEGFTCDCSMTSYSGNQCNDPGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 55318 - protein, 459 aa, Homo sapiens
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGNTDNERFQMVKQKIPFKYNRPVEEWLQEKGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 55319 - protein, 1061 aa, Homo sapiens; identical to SEQ ID NO: 55317

SEQ ID NO: 55320 - protein, 637 aa, Homo sapiens
MHLRIHARRSPPRRPAWTLGIWFLFWGCIVSSVWSSSNVASSSSTSSSPGSHSQHEHHFHGSKHHSVPISIYRSPVSLRGGHAGATYIFGKSGGLILYTWPANDRPSTRSDRLAVGFSTTVKDGILVRIDSAPGLGDFLQLHIEQGKIGVVFNIGTVDISIKEERTPVNDGKYHVVRFTRNGGNATLQVDNWPVNEHYPTGRQLTIFNTQAQIAIGGKDKGRLFQGQLSGLYYDGLKVLNMAAENNPNIKINGSVRLVGEVPSILGTTQTTSMPPEMSTTVMETTTTMATTTTRKNRSTASIQPTSDDLVSSAECSSDDEDFVECEPSTGGELVIPLLVEDPLATPPIATRAPSITLPPTFRPLLTIIETTKDSLSMTSEAGLPCLSDQGSDGCDDDGLVISGYGSGETFDSNLPPTDDEDFYTTFSLVTDKSLSTSIFEGGYKAHAPKWESKDFRPNKVSETSRTTTTSLSPELIRFTASSSSGMVPKLPAGKMNNRDLKPQPDIVLLPLPTAYELDSTKLKSPLITSPMFRNVPTANPTEPGIRRVPGASEVIRESSSTTGMVVGIVAAAALCILILLYAMYKYRNRDEGSYQVDETRNYISNSAQSNGTLMKEKQQSSKSGHKKQKNKDREYYV

SEQ ID NO: 55321 - protein, 142 aa, Homo sapiens
MGLKLNGRYISLILAVQIAYLVQAVRAAGKCDAVFKGFSDCLLKLGDSMANYPQGLDDKTNIKTVCTYWEDFHSCTVTALTDCQEGAKDMWDKLRKESKNLNIQGSLFELCGSGNGAAGSLLPAFPVLLVSLSAALATWLSF

SEQ ID NO: 55322 - protein, 2946 aa, Homo sapiens [sequence omitted]

SEQ ID NO: 55323 - protein, 524 aa, Homo sapiens
MFVNSNGYNLGVREDEVVVNDVDLPPWAKKPEDFVRINRMALESEFVSCQLHQWIDLIFGYKQRGPEAVRALNVFHYLTYEGSVNLDSITDPVLREIPEAYFIRDPHTFLLTKDFIKAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 55324 - protein, 2943 aa, Homo sapiens
MASEKPGPGPGLEPQPVGLIAVGAAGGGGGGSGGGGTGGSGMGELRGASGSGSVMLPAGMINPSVPIRNIRMKFAVLIGLIQVGEVSNRDIVETVLNLLVGGEFDLEMNFIIQDAESITCMTELLEHCDVTCQAEIWSMFTAILRKSVRNLQTSTEVGLIEQVLLKMSAVDDMIADLLVDMLGVLASYSITVKELKLLFSMLRGESGIWPRHAVKLLSVLNQMPQRHGPDTFFNFPGCSAAAIALPPIAKWPYQNGFTLNTWFRMDPLNNINVDKDKPYLYCFRTSKGVGYSAHFVGNCLIVTSLKSKGKGFQHCVKYDFQPRKWYMISIVHIYNRWRNSEIRCYVNGQLVSYGDMAWHVNTNDSYDKCFLGSSETADANRVFCGQLGAVYVFSEALNPAQIFAIHQLGPGYKSTFKFKSESDIHLAEHHKQVLYDGKLASSIAFTYNAKATDAQLCLESSPKENASIFVHSPHALMLQDVKAIVTHSIHSAIHSIGGIQVLFPLFAQLDNRQLNDSQVETTVCATLLAFLVELLKSSVAMQEQMLGGKGFLVIGYLLEKSSRVHITRAVLEQFLSFAKYLDGLSHGAPLLKQLCDHILFNPAIWIHTPAKVQLSLYTYLSAEFIGTATIYTTIRRVGTVLQLMHTLKYYYWVINPADSSGITPKGLDGPRPSQKEIISLRAFMLLFLKQLILKDRGVKEDELQSILNYLLTMHEDENIHDVLQLLVALMSEHPASMIPAFDQRNGIRVIYKLLASKSESIWVQALKVLGYFLKHLGHKRKVEIMHTHSLFTLLGERLMLHTNTVTVTTYNTLYEILTEQVCTQVVHKPHPEPDSTVKIQNPMILKVVATLLKNSTPSAELMEVRRLFLSDMIKLFSNSRENRRCLLQCSVWQDWMFSLGYINPKNSEEQKITEMVYNIFRILLYHAIKYEWGGWRVWVDTLSIAHSKVTYEAHKEYLAKMYEEYQRQEEENIKKGKKGNVSTISGLSSQTTGAKGGMEIREIEDLSQSQSPESETDYPVSTDTRDLLMSTKVSDDILGNSDRPGSGVHVEVHDLLVDIKAEKVEATEVKLDDMDLSPETLVGGENGALVEVESLLDNVYSAAVEKLQNNVHGSVGIIKKNEEKDNGPLITLADEKEDLPNSSTSFLFDKIPKQEEKLLPELSSNHIIPNIQDTQVHLGVSDDLGLLAHMTGSVDLTCTSSIIEEKEFKIHTTSDGMSSISERDLASSTKGLEYAEMTATTLETESSSSKIVPNIDAGSIISDTERSDDGKESGKEIRKIQTTTTTQAVQGRSITQQDRDLRVDLGFRGMPMTEEQRRQFSPGPRTTMFRIPEFKWSPMHQRLLTDLLFALETDVHVWRSHSTKSVMDFVNSNENIIFVHNTIHLISQMVDNIIIACGGILPLLSAATSPTTELENIEVTQGMSAETAVTFLSRLMAMVDVLVFASSLNFSEIEAEKNMSSGGLMRQCLRLVCCVAVRNCLECRQRQRDRGNKSSHGSSKPQEVPQSVTATAASKTPLENVPGNLSPIKDPDRLLQDVDINRLRAVVFRDVDDSKQAQFLALAVVYFISVLMVSKYRDILEPQRETTRTGSQPGRNIRQEINSPTSTVVVIPSIPHPSLNHGFLAKLIPEQSFGHSFYKETPAAFPDTIKEKETPTPGEDIQVESSIPHTDSGIGEEQVASILNGAELETSTGPDAMSELLSTLSSEVKKSQESLTENPSETLKPATSISSISQTKGINVKEILKSLVAAPVEIAECGPEPIPYPDPALKRETQAILPMQFHSFDRSVVVPVKKPPPGSLAVTTVGATTAGSGLPTGSTSNIFAATGATPKSMINTTGAVDSGSSSSSSSSSFVNGATSKNLPAVQTVAPMPEDSAENMSITAKLERALEKVAPLLREIFVDFAPFLSRTLLGSHGQELLIEGLVCMKSSTSVVELVMLLCSQEWQNSIQKNAGLAFIELINEGRLLCHAMKDHIVRVANEAEFILNRQRAEDVHKHAEFESQCAQYAADRREEEKMCDHLISAAKHRDHVTANQLKQKILNILTNKHGAWGAVSHSQLHDFWRLDYWEDDLRRRRRFVRNAFGSTHAEALLKAAIEYGTEEDVVKSKKTFRSQAIVNQNAETELMLEGDDDAVSLLQEKEIDNLAGPVVLSTPAQLIAPVVVAKGTLSITTTEIYFEVDEDDSAFKKIDTKVLAYTEGLHGKWMFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 55325 - protein, 2946 aa, Homo sapiens
MASEKPGPGPGLEPQPVGLIAVGAAGGGGGGSGGGGTGGSGMGELRGASGSGSVMLPAGMINPSVPIRNIRMKFAVLIGLIQVGEVSNRDIVETVLNLLVGGEFDLEMNFIIQDAESITCMTELLEHCDVTCQAEIWSMFTAILRKSVRNLQTSTEVGLIEQVLLKMSAVDDMIADLLVDMLGVLASYSITVKELKLLFSMLRGESGIWPRHAVKLLSVLNQMPQRHGPDTFFNFPGCSAAAIALPPIAKWPYQNGFTLNTWFRMDPLNNINVDKDKPYLYCFRTSKGVGYSAHFVGNCLIVTSLKSKGKGFQHCVKYDFQPRKWYMISIVHIYNRWRNSEIRCYVNGQLVSYGDMAWHVNTNDSYDKCFLGSSETADANRVFCGQLGAVYVFSEALNPAQIFAIHQLGPGYKSTFKFKSESDIHLAEHHKQVLYDGKLASSIAFTYNAKATDAQLCLESSPKENASIFVHSPHALMLQDVKAIVTHSIHSAIHSIGGIQVLFPLFAQLDNRQLNDSQVETTVCATLLAFLVELLKSSVAMQEQMLGGKGFLVIGYLLEKSSRVHITRAVLEQFLSFAKYLDGLSHGAPLLKQLCDHILFNPAIWIHTPAKVQLSLYTYLSAEFIGTATIYTTIRRVGTVLQLMHTLKYYYWVINPADSSGITPKGLDGPRPSQKEIISLRAFMLLFLKQLILKDRGVKEDELQSILNYLLTMHEDENIHDVLQLLVALMSEHPASMIPAFDQRNGIRVIYKLLASKSESIWVQALKVLGYFLKHLGHKRKVEIMHTHSLFTLLGERLMLHTNTVTVTTYNTLYEILTEQVCTQVVHKPHPEPDSTVKIQNPMILKVVATLLKNSTPSAELMEVRRLFLSDMIKLFSNSRENRRCLLQCSVWQDWMFSLGYINPKNSEEQKITEMVYNIFRILLYHAIKYEWGGWRVWVDTLSIAHSKVTYEAHKEYLAKMYEEYQRQEEENIKKGKKGNVSTISGLSSQTTGAKGGMEIREIEDLSQSQSPESETDYPVSTDTRDLLMSTKVSDDILGNSDRPGSGVHVEVHDLLVDIKAEKVEATEVKLDDMDLSPETLVGGENGALVEVESLLDNVYSAAVEKLQNNVHGSVGIIKKNEEKDNGPLITLADEKEDLPNSSTSFLFDKIPKQEEKLLPELSSNHIIPNIQDTQVHLGVSDDLGLLAHMTGSVDLTCTSSIIEEKEFKIHTTSDGMSSISERDLASSTKGLEYAEMTATTLETESSSSKIVPNIDAGSIISDTERSDDGKESGKEIRKIQTTTTTQAVQGRSITQQDRDLRVDLGFRGMPMTEEQRRQFSPGPRTTMFRIPEFKWSPMHQRLLTDLLFALETDVHVWRSHSTKSVMDFVNSNENIIFVHNTIHLISQMVDNIIIACGGILPLLSAATSPTGSKTELENIEVTQGMSAETAVTFLSRLMAMVDVLVFASSLNFSEIEAEKNMSSGGLMRQCLRLVCCVAVRNCLECRQRQRDRGNKSSHGSSKPQEVPQSVTATAASKTPLENVPGNLSPIKDPDRLLQDVDINRLRAVVFRDVDDSKQAQFLALAVVYFISVLMVSKYRDILEPQRETTRTGSQPGRNIRQEINSPTSTVVVIPSIPHPSLNHGFLAKLIPEQSFGHSFYKETPAAFPDTIKEKETPTPGEDIQVESSIPHTDSGIGEEQVASILNGAELETSTGPDAMSELLSTLSSEVKKSQESLTENPSETLKPATSISSISQTKGINVKEILKSLVAAPVEIAECGPEPIPYPDPALKRETQAILPMQFHSFDRSVVVPVKKPPPGSLAVTTVGATTAGSGLPTGSTSNIFAATGATPKSMINTTGAVDSGSSSSSSSSSFVNGATSKNLPAVQTVAPMPEDSAENMSITAKLERALEKVAPLLREIFVDFAPFLSRTLLGSHGQELLIEGLVCMKSSTSVVELVMLLCSQEWQNSIQKNAGLAFIELINEGRLLCHAMKDHIVRVANEAEFILNRQRAEDVHKHAEFESQCAQYAADRREEEKMCDHLISAAKHRDHVTANQLKQKILNILTNKHGAWGAVSHSQLHDFWRLDYWEDDLRRRRRFVRNAFGSTHAEALLKAAIEYGTEEDVVKSKKTFRSQAIVNQNAETELMLEGDDDAVSLLQEKEIDNLAGPVVLSTPAQLIAPVVVAKGTLSITTTEIYFEVDEDDSAFKKIDTKVLAYTEGLHGKWMFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 55326 - protein, 524 aa, Homo sapiens; identical to SEQ ID NO: 55323

SEQ ID NO: 55327 - protein, 1575 aa, Homo sapiens
MHQRLLTDLLFALETDVHVWRSHSTKSVMDFVNSNENIIFVHNTIHLISQMVDNIIIACGGILPLLSAATSPTTELENIEVTQGMSAETAVTFLSRLMAMVDVLVFASSLNFSEIEAEKNMSSGGLMRQCLRLVCCVAVRNCLECRQRQRDRGNKSSHGSSKPQEVPQSVTATAASKTPLENVPGNLSPIKDPDRLLQDVDINRLRAVVFRDVDDSKQAQFLALAVVYFISVLMVSKYRDILEPQRETTRTGSQPGRNIRQEINSPTSTETPAAFPDTIKEKETPTPGEDIQVESSIPHTDSGIGEEQVASILNGAELETSTGPDAMSELLSTLSSEVKKSQESLTENPSETLKPATSISSISQTKGINVKEILKSLVAAPVEIAECGPEPIPYPDPALKRETQAILPMQFHSFDRSVVVPVKKPPPGSLAVTTVGATTAGSGLPTGSTSNIFAATGATPKSMINTTGAVDSGSSSSSSSSSFVNGATSKNLPAVQTVAPMPEDSAENMSITAKLERALEKVAPLLREIFVDFAPFLSRTLLGSHGQELLIEGLVCMKSSTSVVELVMLLCSQEWQNSIQKNAGLAFIELINEGRLLCHAMKDHIVRVANEAEFILNRQRAEDVHKHAEFESQCAQYAADRREEEKMCDHLISAAKHRDHVTANQLKQKILNILTNKHGAWGAVSHSQLHDFWRLDYWEDDLRRRRRFVRNAFGSTHAEALLKAAIEYGTEEDVVKSKKTFRSQAIVNQNAETELMLEGDDDAVSLLQEKEIDNLAGPVVLSTPAQLIAPVVVAKGTLSITTTEIYFEVDEDDSAFKKIDTKVLAYTEGLHGKWMFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSECDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 55328 - protein, 739 aa, Homo sapiens
MFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKKPEDFVRINRMALESEFVSCQLHQWIDLIFGYKQRGPEAVRALNVFHYLTYEGSVNLDSITDPVLREAMEAQIQNFGQTPSQLLIEPHPPRSSAMHLCFLPQSPLMFKDQMQQDVIMVLKFPSNSPVTHVAANTLPHLTIPAVVTVTCSRLFAVNRWHNTVGLRGAPGYSLDQAHHLPIEMDPLIANNSGVNKRQITDLVDQSIQINAHCFVVTADNRYILICGFWDKSFRVYSTETGKLTQIVFGHWDVVTCLARSESYIGGDCYIVSGSRDATLLLWYWSGRHHIIGDNPNSSDYPAPRAVLTGHDHEVVCVSVCAELGLVISGAKEGPCLVHTITGDLLRALEGPENCLFPRLISVSSEGHCIIYYERGRFSNFSINGKLLAQMEINDSTRAILLSSDGQNLVTGGDNGVVEVWQACDFKQLYIYPGCDAGIRAMDLSHDQRTLITGMASGSIVAFNIDFNRWHYEHQNRY

SEQ ID NO: 55329 - protein, 2946 aa, Homo sapiens [sequence omitted]

SEQ ID NO: 55330 - protein, 277 aa, Homo sapiens
MFSEIRAVFSRRYLLQNTALEVFMANRTSVMFNFPDQATVKKVVYSLPRVGVGTSYGLPQARRISLATPRQLYKSSNMTQRWQRREISNFEYLMFLNTIAGRTYNDLNQYPVFPWVLTNYESEELDLTLPGNFRDLSKPIGALNPKRAVFYAERYETWEDDQSPPYHYNTHYSTATSTLSWLVRIEPFTTFFLNANDGKFDHPDRTFSSVARSWRTSQRDTSDVKELIPEFYYLPEMFVNSNGYNLGVREDEVVVNDVDLPPWAKNLKTLCGSTGWP

SEQ ID NO: 55331 - protein, 2604 aa, Homo sapiens
MASRERLFELWMLYCTKKDPDYLKLWLDTFVSSYEQFLDVDFEKLPTRVDDMPPGISLLPDNILQVLRIQLLQCVQKMADGLEEQQQALSILLVKFFIILCRNLSNVEEIGTCSYINYVITMTTLYIQQLKSKKKEKEMADQTCIEEFVIHALAFCESLYDPYRNWRHRISGRILSTVEKSRQKYKPASLTVEFVPFFYQCFQESEHLKESLKCCLLHLFGAIVAGGQRNALQAISPATMEVLMRVLADCDSWEDGDPEEVGRKAELTLKCLTEVVHILLSSNSDQRQVETSTILENYFKLLNSDHSALPNQRRSRQWENRFIALQIKMLNTITAMLDCTDRPVLQAIFLNSNCFEHLIRLLQNCKVFQGQLDCLAISTIQALTAVMNKSPAAKEVFKERIGYTHMLEVLKSLGQPPLELLKELMNMAVEGDHTSVGILGISNVQPLLLLIQWLPELQSHDLQIFISDWLKRICCINRQSRTTCVNANMGIRIIETLDLHSSLHQTCAENLIAIHGSLGSQSVSSEEIRRLLRLLRVDESESVHPYVTPVTRAILTMARKLSLESALQYFNLSHSMAGISVPPIQKWPGSAFSFSAWFCLDQDQLTLGIANKGGKRKQLYSFFTGSGMGFEAFITHSGMLVVAVCTKREYATVMLPDHSFCDSLWHNITVVHMPGKRPFGQSFVYIYDNGQQKVSAPLRFPAMNEPFTSCCIGSAGQRTTTPPPSQIPDPPFSSPITPHRTSFGGILSSASWGGTIEKSKLITKLISAGTQDSEWGCPTSLEGQLGSVIIFYEPLQPPQVKALYLAGPNCLSPWKCQESDMADLPGNILLYYTAKACKNSICLDLSTNCLHGRLTGNKVVNWDIKDIINCIGGLNVLFPLLEQISHFSEGQIPEEKNESTVPESVTPVEGDWLVWTSTKASESRLERNLVATFILIVKHFIQRHPINQGNLIHSHGVATLGALLQKVPSTLMDVNVLMAVQLLIEQVSLEKNMQLLQQMYQYLLFDFRIWNRGDFPFRIGHIQYLSTIIKDSRRVFRKKYGVQFLLDTLRIYYGNGCKYNELSLDDIRTIRTSLYGLIKYFLCKGGSHEEIQSIMGYIAATNEEEQLFGILDVLFSLLRTSPTRGQLFLLLFEPGNADILYALLLNQKYSDRLREIIFKIMEQMLKCTNVYERSKQHIRLREVGYSGLGLLLNEALVNTSLIKNLTHQIINTDPVINFKDLLSVVYISHRAHINVRVAICRKVLQILQFQPDAAHQISQQVGWQDTLVRLFLKAKFENGNTLHKHSRAVLMKDNDKNMSTEDTKKNSDEKTDEEKITSFASANVSSDQWSLEDRHSLDSNTPLFPEDSSVGELSFKSENQEEFWHSNPSHLSLDLSGIDSCEMSDSGSQVPDSLPSTPSPVESTKSFSVHSDRESSITNDMGFSDDFSLLESQERCEEELLQLLTHILNYVMCKGLEKSDDDTWIERGQVFSALSKPGISSELLRPSDEIKLTLLQKMLEWAISENREAKTNPVTAENAFRLVLIIQDFLQSEGLVNSNMWTEKLLEDMMLLFDCLSVCYSESPVWVKLSQIQIQLLLGFIGRGNLQVCAMASAKLNTLLQTKVIENQDEACYILGKLEHVLSQSIKEQTEIYSFLIPLVRTLVSKIYELLFMNLHLPSLPFTNGSSSFFEDFQEYCNSNEWQVYIEKYIVPYMKQYEAHTFYDGHENMALYWKDCYEALMVNMHKRDREGGESKLKFQELFVEPFNRKARQENLRYNNMLKQLSSQQLATLRRWKAIQLYLTCERGPWAKRKQNPIHWKLANVENYSRMRLKLVPNYNFKTHEEASALRDNLGIQHSQPSSDTLLLEVVKQVKVSDMVEDKLDLPEEDITARVNVDEKEEQDQKEKLVLMEDCELITIIDVIPGRLEITTQHIYFYDGSIEKEDGVGFDFKWPHSQIREIHLRRYNLRRSALEIFHVDQSNYFLNFKKEVRNKIYSRLLSLHSPNSYYGSRSPQELFKASGLTQKWVNREISNFDYLIQINTMAGRTYNDLAQYPVFPWILQDYTSEELDLNNPAVFRDLSKPIGVVNEKNAKAMREKYENFEDPMGTIDKFHYGTHYSNSAGVMHYLIRVEPFTTLHIQLQSGRFDCADRQFHSIPATWQALMDNPYDVKELIPEFFYFPEFLENQNQFNLGRLQISKELVNDVILPKWAKSAEDFIYKHRKALESEYVSAHLHEWIDLIFGYKQRGPAAVEALNVFYYCSYEGAVDLDALTDEKERKALEGMINNFGQTPCQLLKITISMNYVIGTHGWLPYDRNISNYFTFIKDQTVTNPKTQRSINGSFAPGLEITSKLFVVSHDAKLLFSAGYWDNSIQVMSLTKGKIISHIIRHMDIVTCLATDYCGIHLISGSRDTTCMIWQITQQGGVPVGLASKPFQILYGHTNEVLSVGISTELDMAVSGSRDGTVIIHTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEMRSGQLSRKFWGSSKRLSQISAGETEYNTQDSK

SEQ ID NO: 55332 - protein, 2694 aa, Homo sapiens
MASRERLFELWMLYCTKKDPDYLKLWLDTFVSSYEQFLDVDFEKLPTRVDDMPPGISLLPDNILQVLRIQLLQCVQKMADGLEEQQQALSILLVKFFIILCRNLSNVEEIGTCSYINYVITMTTLYIQQLKSKKKEKEMADQTCIEEFVIHALAFCESLYDPYRNWRHRISGRILSTVEKSRQKYKPASLTVEFVPFFYQCFQESEHLKESLKCCLLHLFGAIVAGGQRNALQAISPATMEVLMRVLADCDSWEDGDPEEVGRKAELTLKCLTEVVHILLSSNSDQRQVETSTILENYFKLLNSDHSALPNQRRSRQWENRFIALQIKMLNTITAMLDCTDRPVLQAIFLNSNCFEHLIRLLQNCKVFQGQLDCLAISTIQALTAVMNKSPAAKEVFKERIGYTHMLEVLKSLGQPPLELLKELMNMAVEGDHTSVGILGISNVQPLLLLIQWLPELQSHDLQIFISDWLKRICCINRQSRTTCVNANMGIRIIETLDLHSSLHQTCAENLIAIHGSLGSQSVSSEEIRRLLRLLRVDESESVHPYVTPVTRAILTMARKLSLESALQYFNLSHSMAGISVPPIQKWPGSAFSFSAWFCLDQDQLTLGIANKGGKRKQLYSFFTGSGMGFEAFITHSGMLVVAVCTKREYATVMLPDHSFCDSLWHNITVVHMPGKRPFGQSFVYIYDNGQQKVSAPLRFPAMNEPFTSCCIGSAGQRTTTPPPSQIPDPPFSSPITPHRTSFGGILSSASWGGTIEKSKLITKLISAGTQDSEWGCPTSLEGQLGSVIIFYEPLQPPQVKALYLAGPNCLSPWKCQESDMADLPGNILLYYTAKACKNSICLDLSTNCLHGRLTGNKVVNWDIKDIINCIGGLNVLFPLLEQISHFSEGQIPEEKNESTVPESVTPVEGDWLVWTSTKASESRLERNLVATFILIVKHFIQRHPINQGNLIHSHGVATLGALLQKVPSTLMDVNVLMAVQLLIEQVSLEKNMQLLQQMYQYLLFDFRIWNRGDFPFRIGHIQYLSTIIKDSRRVFRKKYGVQFLLDTLRIYYGNGCKYNELSLDDIRTIRTSLYGLIKYFLCKGGSHEEIQSIMGYIAATNEEEQLFGILDVLFSLLRTSPTRGQLFLLLFEPGNADILYALLLNQKYSDRLREIIFKIMEQMLKCTNVYERSKQHIRLREVGYSGLGLLLNEALVNTSLIKNLTHQIINTDPVINFKDLLSVVYISHRAHINVRVAICRKVLQILQFQPDAAHQISQQVGWQDTLVRLFLKAKFENGNTLHKHSRAVLMKDNDKNMSTEDTKKNSDEKTDEEKITSFASANVSSDQWSLEDRHSLDSNTPLFPEDSSVGELSFKSENQEEFWHSNPSHLSLDLSGIDSCEMSDSGSQVPDSLPSTPSPVESTKSFSVHSDRESSITNDMGFSDDFSLLESQERCEEELLQLLTHILNYVMCKGLEKSDDDTWIERGQVFSALSKPGISSELLRPSDEIKLTLLQKMLEWAISENREAKTNPVTAENAFRLVLIIQDFLQSEGLVNSNMWTEKLLEDMMLLFDCLSVCYSESPVWVKLSQIQIQLLLGFIGRGNLQVCAMASAKLNTLLQTKVIENQDEACYILGKLEHVLSQSIKEQTEIYSFLIPLVRTLVSKIYELLFMNLHLPSLPFTNGSSSFFEDFQEYCNSNEWQVYIEKYIVPYMKQYEAHTFYDGHENMALYWKDCYEALMVNMHKRDREGGESKLKFQELFVEPFNRKARQENLRYNNMLKQLSSQQLATLRRWKAIQLYLTCERGPWAKRKQNPIHWKLANVENYSRMRLKLVPNYNFKTHEEASALRDNLGIQHSQPSSDTLLLEVVKQVKVSDMVEDKLDLPEEDITARVNVDEKEEQDQKEKLVLMEDCELITIIDVIPGRLEITTQHIYFYDGSIEKEDGVGFDFKWPHSQIREIHLRRYNLRRSALEIFHVDQSNYFLNFKKEVRNKIYSRLLSLHSPNSYYGSRSPQELFKASGLTQKWVNREISNFDYLIQINTMAGRTYNDLAQYPVFPWILQDYTSEELDLNNPAVFRDLSKPIGVVNEKNAKAMREKYENFEDPMGTIDKFHYGTHYSNSAGVMHYLIRVEPFTTLHIQLQSGRFDCADRQFHSIPATWQALMDNPYDVKELIPEFFYFPEFLENQNQFNLGRLQISKELVNDVILPKWAKSAEDFIYKHRKALESEYVSAHLHEWIDLIFGYKQRGPAAVEALNVFYYCSYEGAVDLDALTDEKERKALEGMINNFGQTPCQLLKEPHPPRLSAEEAVQKPTKIDTSTLNLFQHLPELKSFFIEGISDGIPLLKATIPKNQYRSFMSQGSPELLITISMNYVIGTHGWLPYDRNISNYFTFIKDQTVTNPKTQRSINGSFAPGLEITSKLFVVSHDAKLLFSAGYWDNSIQVMSLTKGKIISHIIRHMDIVTCLATDYCGIHLISGSRDTTCMIWQITQQGGVPVGLASKPFQILYGHTNEVLSVGISTELDMAVSGSRDGTVIIHTIQKGQYMRTLRPPCESSLFLTIPNLAISWEGHIVVYSSTEEKTTLKDKNALHLFSINGKYLGSQILKEQVSDICIIGEHIVTGSIQGFLSIRDLHSLNLSINPLAMRLPIHCVCVTKEYSHILVGLEDGKLIVVGVGKPAEMRSGQLSRKFWGSSKRLSQISAGETEYNTQDSK

SEQ ID NO: 55333 - protein, 2570 aa, Homo sapiens
MAASERLYELWLLYYAQKDLGYLQQWLKAFVGAFKKSISLSSLEPRRPEEAGAEVPLLPLDELHVLAEQLHQADLEQALLLLKLFIILCRNLENIEAGRGQVLVPRVLALLTKLVAELKGCPPPQGRGTQLENVALHALLLCEGLFDPYQTWRRQRSGEVISSKEKSKYKFPPAALPQEFSAFFQESLQNADHLPPILLLRLIHLFCAVLAGGKENGQMAVSDGSVKGLLSVVRGWSRGPAPDPCLVPLALEALVGAVHVLHASRAPPRGPELRALLESYFHVLNADWPAGLSSGPEEALVTLRVSMLDAIPMMLACEDRPVLQATFLSNNCFEHLTRLIQNSKLYLQSRAPPEGDSDLATRLLTEPDVQKVLDQDTDAIAVHVVRVLTCIMSDSPSAKEVFKERIGYPHLQEVLQSHGPPTHRLLQELLNMAVEGDHSMCPPPPIRNEQPVLVLAQWLPSLPTAELRLFLAQRLRWLCDSCPASRATCVQAGLVGCLLETLSTGLALEARCQEQLLALLQALGRVSIRPMELRHLLRPRPGLDSEPGGAEAGKARHAGAVIRTLSGMARHQGPARALRYFDLTPSMAGIMVPPVQRWPGPGFTFHAWLCLHPMDTAPTPAPTRPLQRKQLYSFFTSSGSGFEAFFTAAGTLVVAVCTRKEYLTMSLPEVSFADSAWHCVAIVHVPGRRPFSQNLVHVYKDGHLVKTAPLRCPSLSEPFSSCCIGSAGYRTTTTTTGLPTPPVPATLAYTHPALTRSQSVPASTGLGWGSGLVAPLQEGSIDSTLAGTQDTRWGSPTSLEGELGAVAIFHEALQATALRTLCTLGPNETAPFKPEGELHELSTRLLLHYSPQACKNNICLDLSPSHGLDGRLTGHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQILRRLQQNERLPERSRQRLRLRECGLQGLVACLPEGTVSPQLCQGLYKLFLGAGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 55334 - protein, 615 aa, Homo sapiens
MEPALGPGVQKDLGYLQQWLKAFVGAFKKSISLSSLEPRRPEEAGAEVPLLPLDELHVLAEQLHQADLEQALLLLKLFIILCRNLENIEAGRGQVLVPRVLALLTKLVAELKGCPPPQGRGTQLENVALHALLLCEGLFDPYQTWRRQRSGEVISSKEKSKYKFPPAALPQEFSAFFQESLQNADHLPPILLLRLIHLFCAVLAGGKENGQMAVSDGSVKGLLSVVRGWSRGPAPDPCLVPLALEALVGAVHVLHASRAPPRGPELRALLESYFHVLNADWPAGLSSGPEEALVTLRVSMLDAIPMMLACEDRPVLQATFLSNNCFEHLTRLIQNSKVLDQDTDAIAVHVVRVLTCIMSDSPSAKEVFKERIGYPHLQEVLQSHGPPTHRLLQELLNMAVEGDHSMCPPPPIRNEQPVLVLAQWLPSLPTAELRLFLAQRLRWLCDSCPASRATCVQAGLVGCLLETLSTGLALEARCQEQLLALLQALGRVSIRPMELRHLLRPRPGLDSEPGGAEAGKARHAGAVIRTLSGMARHQGPARALRYFDLTPSMAGIMVPPVQRWPGPGFTFHAWLCLHPMDTAPTPAPPTLPSSGIGGRCYPLRDWRAEVPPLAG

SEQ ID NO: 55335 - protein, 1003 aa, Homo sapiens
MSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 55336 - protein, 697 aa, Homo sapiens
MLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 55337 - protein, 2754 aa, Homo sapiens
MAASERLYELWLLYYAQKDLGYLQQWLKAFVGAFKKSISLSSLEPRRPEEAGAEVPLLPLDELHVLAEQLHQADLEQALLLLKLFIILCRNLENIEAGRGQVLVPRVLALLTKLVAELKGCPPPQGRGTQLENVALHALLLCEGLFDPYQTWRRQRSGEVISSKEKSKYKFPPAALPQEFSAFFQESLQNADHLPPILLLRLIHLFCAVLAGGKENGQMAVSDGSVKGLLSVVRGWSRGPAPDPCLVPLALEALVGAVHVLHASRAPPRGPELRALLESYFHVLNADWPAGLSSGPEEALVTLRVSMLDAIPMMLACEDRPVLQATFLSNNCFEHLTRLIQNSKLYLQSRAPPEGDSDLATRLLTEPDVQKVLDQDTDAIAVHVVRVLTCIMSDSPSAKEVFKERIGYPHLQEVLQSHGPPTHRLLQELLNMAVEGDHSMCPPPPIRNEQPVLVLAQWLPSLPTAELRLFLAQRLRWLCDSCPASRATCVQAGLVGCLLETLSTGLALEARCQEQLLALLQALGRVSIRPMELRHLLRPRPGLDSEPGGAEAGKARHAGAVIRTLSGMARHQGPARALRYFDLTPSMAGIMVPPVQRWPGPGFTFHAWLCLHPMDTAPTPAPTRPLQRKQLYSFFTSSGSGFEAFFTAAGTLVVAVCTRKEYLTMSLPEVSFADSAWHCVAIVHVPGRRPFSQNLVHVYKDGHLVKTAPLRCPSLSEPFSSCCIGSAGYRTTTTTTGLPTPPVPATLAYTHPALTRSQSVPASTGLGWGSGLVAPLQEGSIDSTLAGTQDTRWGSPTSLEGELGAVAIFHEALQATALRTLCTLGPNETAPFKPEGELHELSTRLLLHYSPQACKNNICLDLSPSHGLDGRLTGHRVETWDVKDVVNCVGGMGALLPLLERVAAQPKEAEAGPAETHDLVGPELTSGHNTQGLVLPLGKSSEERMERNAVAAFLLMLRNFLQGHMVNQESLVQCQGPAIIGALLRKVPSWAMDMNVLMSAQLLMEQVAAEGSGPLLYLLYQHLLFNFHLWTLSDFAVRLGHIQYMSSIVREHRQKLRKKYGVQFILDALRTHYSPQRERPLAADDLRTVQTSLLGLAREFLVRSLSADDVQVTQTMLSFLAATGDDGQAVGALDLLLALLHGSLVQESLAVFLLEPGNLEVLLALLVRPGSLPLLPDRVCKILRRLQQNERLPERSRQRLRLRECGLQGLVACLPEGTVSPQLCQGLYKLFLGADCLNLSDLLAVVQLSLQADLSVRLDICRQLFHLIYGQPDVVRLLARQAGWQDVLTRLYVLEAATAGSPPPSSPESPTSPKPAPPKPPTESPAEPSDVFLPSEAPCPDPDGFYHALSPFCTPFDLGLERSSVGSGNTAGGGGSSGTLTPASQPGTPSPLDGPRPFPAAPGRHSSSLSNVLEDGSLPEPTISGDDTSNTSNPQQTSEEELCNLLTNVLFSVTWRGVEGSDEAAWRERGQVFSVLTQLGASATLVRPPDCIKRSLLEMMLESALTDIKEAPVGVLASLTQQALWLLRLLQDFLCAEGHGNQELWSEKLFEGVCSLLDRLGAWPHLANGTADLREMAQIGLRLVLGYILLEDPQLHAQAYVRLHMLLQTAVPARREEACYVLSKLEAALGRVLNTSSLESATDEAGSPLAAAAAAAAAERCSWLVPLVRTLLDRAYEPLGLQWGLPSLPPTNGSPTFFEDFQAFCATPEWRHFIDKQVQPTMSQFEMDTYAKSHDLMSGFWNACYDMLMSSGQRRQWERAQSRRAFQELVLEPAQRRARLEGLRYTAVLKQQATQHSMALLHWGALWRQLASPCGAWALRDTPIPRWKLSSAETYSRMRLKLVPNHHFDPHLEASALRDNLGEVPLTPTEEASLPLAVTKEAKVSTPPELLQEDQLGEDELAELETPMEAAELDEQREKLVLSAECQLVTVVAVVPGLLEVTTQNVYFYDGSTERVETEEGIGYDFRRPLAQLREVHLRRFNLRRSALELFFIDQANYFLNFPCKVGTTPVSSPSQTPRPQPGPIPPHTQVRNQVYSWLLRLRPPSQGYLSSRSPQEMLRASGLTQKWVQREISNFEYLMQLNTIAGRTYNDLSQYPVFPWVLQDYVSPTLDLSNPAVFRDLSKPIGVVNPKHAQLVREKYESFEDPAGTIDKFHYGTHYSNAAGVMHYLIRVEPFTSLHVQLQSGRFDCSDRQFHSVAAAWQARLESPADVKELIPEFFYFPDFLENQNGFDLGCLQLTNEKVGDVVLPPWASSPEDFIQQHRQALESEYVSAHLHEWIDLIFGYKQRGPAAEEALNVFYYCTYEGAVDLDHVTDERERKALEGIISNFGQTPCQLLKEPHPTRLSAEEAAHRLARLDTNSPSIFQHLDELKAFFAEVVSDGVPLVLALVPHRQPHSFITQGSPDLLVTVSASGLLGTHSWLPYDRNISNYFSFSKDPTMGSHKTQRLLSGPWVPGSGVSGQALAVAPDGKLLFSGGHWDGSLRVTALPRGKLLSQLSCHLDVVTCLALDTCGIYLISGSRDTTCMVWRLLHQGGLSVGLAPKPVQVLYGHGAAVSCVAISTELDMAVSGSEDGTVIIHTVRRGQFVAALRPLGATFPGPIFHLALGSEGQIVVQSSAWERPGAQVTYSLHLYSVNGKLRASLPLAEQPTALTVTEDFVLLGTAQCALHILQLNTLLPAAPPLPMKVAIRSVAVTKERSHVLVGLEDGKLIVVVAGQPSEVRSSQFARKLWRSSRRISQVSSGETEYNPTEAR

SEQ ID NO: 55338 - protein, 2371 aa, Homo sapiens
MAAPESGPALSPGTAEGEEETILYDLLVNTEWPPETEVQPRGNQKHGASFIITKAIRDRLLFLRQYIWYSPAPFLLPDGLVRLVNKQINWHLVLASNGKLLAAVQDQCVEIRSAKDDFTSIIGKCQVPKDPKPQWRRVAWSYDCTLLAYAESTGTVRVFDLMGSELFVISPASSFIGDLSYAIAGLIFLEYKASAQWSAELLVINYRGELRSYLVSVGTNQSYQESHCFSFSSHYPHGINTAIYHPGHRLLLVGGCETAEVGMSKASSCGLSAWRVLSGSPYYKQVTNGGDGVTAVPKTLGLLRMLSVKFYSRQGQEQDGIFKMSLSPDGMLLAAIHFSGKLSIWAIPSLKQQGEWGQNEQPGYDDLNPDWRLSTEKRKKIKDKESFYPLIDVNWWADSAVTLARCSGALTVSSVKTLKNLLGKSCEWFEPSPQVTATHDGGFLSLECEIKLAPKRSRLETRAGEEDEGEEDSDSDYEISAKARYFGYIKQGLYLVTEMERFAPPRKRPRTITKNYRLVSLRSTTPEELYQRKIESEEYEEALSLAHTYGLDTDLVYQRQWRKSAVNVASIQNYLSKIKKRSWVLHECLERVPENVDAAKELLQYGLKGTDLEALLAIGKGADDGRFTLPGEIDIDSISYEELSPPDEEPAKNKKEKELKKRQELLKLVNFSKLTLEQKELCRCRRKLLTYLDRLATYEEILGVPHASEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQVDCALSLIRLGMERNIPGLLVLCDNLVTLETLVYEARCDVTLTLKELQQMKDIEKLRLLMNSCSEDKYVTSAYQWMVPFLHRCEKQSPGVANELLKEYLVTLAKGDLKFPLKIFQHSKPDLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWV

SEQ ID NO: 55339 - protein, 2251 aa, Homo sapiens
MAAPESGPALSPGTAEGEEETILYDLLVNTEWPPETEVQPRGNQKHGASFIITKAIRDRLLFLRQYIWYSPAPFLLPDGLVRLVNKQINWHLVLASNGKLLAAVQDQCVEIRSAKDDFTSIIGKCQVPKDPKPQWRRVAWSYDCTLLAYAESTGTVRVFDLMGSELFVISPASSFIGDLSYAIAGLIFLEYKASAQWSAELLVINYRGELRSYLVSVGTNQSYQESHCFSFSSHYPHGINTAIYHPGHRLLLVGGCETAEVGMSKASSCGLSAWRVLSGSPYYKQVTNGGDGVTAVPKTLGLLRMLSVKFYSRQGQEQDGIFKMSLSPDGMLLAAIHFSGKLSIWAIPSLKQQGEWGQNEQPGYDDLNPDWRLSTEKRKKIKDKESFYPLIDVNWWADSAVTLARCSGALTVSSVKTLKNLLGKSCEWFEPSPQVTATHDGGFLSLECEIKLAPKRSRLETRAGEEDEGEEDSDSDYEISAKARYFGYIKQGLYLVTEMERFAPPRKRPRTITKNYRLVSLRSTTPEELYQRKIESEEYEEALSLAHTYGLDTDLVYQRQWRKSAVNVASIQNYLSKIKKRSWVLHECLERVPENVDAAKELLQYGLKGTDLEALLAIGKGADDGRFTLPGEIDIDSISYEELSPPDEEPAKNKKEKELKKRQELLKLVNFSKLTLEQKELCRCRRKLLTYLDRLATYEEILGVPHASEQRYDAEFFKKFRNQNIVLSARTYAQESNVQALEILFTYHGSDLLPHRLAILSNFPETTSPHEYSVLLPEACFNGDSLMIIPWHEHKHRAKDWCEELACRMVVEPNLQDESEFLYAAQPELLRFRMTQLTVEKVMDWYQTRAEEIEHYARQLQQKIIPDQDQLMAIALECIYTCERNDQLCLCYDLLECLPERGYGDKTEATTKLHDMVDQLEQILSVSELLEKHGLEKPISFVKNTQSSSEEARKLMVRLTRHTGRKQPPVSESHWRTLLQDMLTMQQNVYTCLDSDACYEIFTESLLCSSRLENIHLAGQMMHCSACSENPPAGIAHKGKPHYRVSYEKSIDLVLAASREYFNSSTNLTDSCMDLARCCLQLITDRPPAIQEELDLIQAVGCLEEFGVKILPLQVRLCPDRISLIKECISQSPTCYKQSTKLLGLAELLRVAGENPEERRGQVLILLVEQALRFHDYKAASMHCQELMATGYPKSWDVCSQLGQSEGYQDLATRQELMAFALTHCPPSSIELLLAASSSLQTEILYQRVNFQIHHEGGENISASPLTSKAVQEDEVGVPGSNSADLLRWTTATTMKVLSNTTTTTKAVLQAVSDGQWWKKSLTYLRPLQGQKCGGAYQIGTTANEDLEKQGCHPFYESVISNPFVAESEGTYDTYQHVPVESFAEVLLRTGKLAEAKNKGEVFPTTEVLLQLASEALPNDMTLALAYLLALPQVLDANRCFEKQSPSALSLQLAAYYYSLQIYARLAPCFRDKCHPLYRADPKELIKMVTRHVTRHEHEAWPEDLISLTKQLHCYNERLLDFTQAQILQGLRKGVDVQRFTADDQYKRETILGLAETLEESVYSIAISLAQRYSVSRWEVFMTHLEFLFTDSGLSTLEIENRAQDLHLFETLKTDPEAFHQHMVKYIYPTIGGFDHERLQYYFTLLENCGCADLGNCAIKPETHIRLLKKFKVVASGLNYKKLTDENMSPLEALEPVLSSQNILSISKLVPKIPEKDGQMLSPSSLYTIWLQKLFWTGDPHLIKQVPGSSPEWLHAYDVCMKYFDRLHPGDLITVVDAVTFSPKAVTKLSVEARKEMTRKAIKTVKHFIEKPRKRNSEDEAQEAKDSKVTYADTLNHLEKSLAHLETLSHSFILSLKNSEQETLQKYSHLYDLSRSEKEKLHDEAVAICLDGQPLAMIQQLLEVAVGPLDISPKDIVQSAIMKIISALSGGSADLGGPRDPLKVLEGVVAAVHASVDKGEELVSPEDLLEWLRPFCADDAWPVRPRIHVLQILGQSFHLTEEDSKLLVFFRTEAILKASWPQRQVDIADIENEENRYCLFMELLESSHHEAEFQHLVLLLQAWPPMKSEYVITNNPWVRLATVMLTRCTMENKEGLGNEVLKMCRSLYNTKQMLPAEGVKELCLLLLNQSLLLPSLKLLLESRDEHLHEMALEQITAVTTVNDSNCDQELLSLLLDAKLLVKCVSTPFYPRIVDHLLASLQQGRWDAEELGRHLREAGHEAEAGSLLLAVRGTHQAFRTFSTALRAAQHWV

SEQ ID NO: 55340 - protein, 3553 aa, Homo sapiens
MVVSAGPWSSEKAEMNILEINETLRPQLAEKKQQFRNLKEKCFLTQLAGFLANRQKKYKYEECKDLIKFMLRNERQFKEEKLAEQLKQAEELRQYKVLVHSQERELTQLREKLREGRDASRSLYEHLQALLTPDEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGFAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGFAVDMDEIEKYQEVEEDQDPSCPRLSRELLDEKEPEVLQDSLDRCYSTPSGYLELPDLGQPYSSAVYSLEEQYLGLALDVDRIKKDEEEEEDQDPPCPRLSRELLEVVAPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGMAVDMDEIEKYQEVEEDQDPSCPRLSRELLDEKEPEVLQDSLNRCYSTPSGYLELPDLGQPYSSAVYSLEEQYLGLALDVDRIKKDQEEEEDEDQDPPCPRLSRELLEVVEPEVLQDSLDRCYSTPSSCLEQPDSCQPYGSSFYALEENHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEENHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEENHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEENHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEENHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPKVLQDSLDRCYSTPSGCLELCDSCQPYRSAFYVLEQQRVGLAVDMDEIEKYQEVEEDQDPSCPRLSRELLDEKGPEVLQDSLDRCYSTPSGCLELCDSCQPYRSAFYILEQQRVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELCDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDKIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 55341 - protein, 299 aa, Homo sapiens
MVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRTSVGSSEKGGPRGNRSQAQQGAAG

SEQ ID NO: 55342 - protein, 669 aa, Homo sapiens
MVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPSRELLDEKGPEVFQDSQDRCYSTPSGCLELTDSCQPYRSAFYILEQQRVGLAIDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLDEKGPEVLQDSLDRCYSTPSGCLELTDSCQPYRSAFYVLEQQHVGLAVDMDEIEKKGKGKKRRGRRSKKERRRGRKEGEEDQNPPCPRLNGVLMEVEEREVLQDSLDRCYSTPSMYFELPDSFQHYRSVFYSFEEQHISFALYVDNRFFTLTVTSLHLVFQMGVIFPQ

SEQ ID NO: 55343 - protein, 673 aa, Homo sapiens [sequence omitted]

SEQ ID NO: 55344 - protein, 172 aa, Homo sapiens
MAVDIGRHRWDQVKKEDQEATGPSRELLDEKGPEVFQDSQDRCYSTPSGCLELTDSCQPYRSAFYILEQQRVGLAIDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPR

SEQ ID NO: 55345 - protein, 764 aa, Homo sapiens
MFSNSTGRLPGQPTEEIQQYKVLVHSQERELTQLREKLREGRDASRSLYEHLQALLTPDEPDKSQGQDLQEQLAEGCRLAQHLVQKLSPENDEDEDEDVQVEEAEKVLESSAPREVQKAEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLRPQLAEKKQQFRNLKEKCFLTQLSGFLANQQKKYKYEECKDLIKFMLRNERQFKEEKLAEQLKQAEELRQYKVLVHAQERELTQLKEKLREGRDASRSLNEHLQALLTPYEPDKSQGQDLQEQLAEGCRLAQHLVQKLSPENDNDDDEDVQVEVAEKVQKSSAPREMQKAEEKEVPEDSLEECAITYSNSHGSYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQHVGLAVDMDEIEKYQEVEEDQDPSCPRLSRELLDEKEPEVLQDSLDRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGR

SEQ ID NO: 55346 - protein, 34 aa, Homo sapiens
IGSSSHVEWEDAVHIIPENESDDEEEEEKGPVSP

SEQ ID NO: 55347 - protein, 838 aa, Homo sapiens
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKPKSHLRKTKSTQLSLAHPLMLNGRMLYTLSQKMKVMMRKRKKKGQCLPGICRSLKRRKSPRSPGMKVIRLSQFLLKGHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 55348 - protein, 790 aa, Homo sapiens
MFSNSTGRLPGQPTEEIQQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 55349 - protein, 85 aa, Homo sapiens
EMQKAEEKEVPEDSLEECAITCSNSHGPYDSNQPHRKTKITFEEDKVDSTLIGSSSHVEWEDAVHIIPENESDDEEEEEKGPVSP

SEQ ID NO: 55350 - protein, 366 aa, Homo sapiens
LASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLCYSTPSSCLEQPDSCQPYGSSFYALEEKHVGFSLDVGEIEKKGKGKKRRGRRSKKKRRRGRKEGEEDQNPPCPRLSSVLMEVEVPEVLQDSLDRYYSTPSMYFELPDSFQHYRSVFYSFEEQHISFALDMDNRFFTLTVRSLHLVFQMGVIFPQ

SEQ ID NO: 55351 - protein, 865 aa, Homo sapiens
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPEDSLEECAITCSNSHGPCDSIQPHKNIKITFEEDKVNSSLVVDRESSHDGCQDALNILPVPGPTSSATNVSMVVSAGPLSSEKAEMNILEINEKLCPQLAEKKQQFRSLKEKCFVTQVACFLAKQQNKYKYEECKDLIKSMLRNERQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLDEKEPEVLQDSLDRCYSTPSVYLGLTDSCQPYRSAFYVLEQQRIGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSAAC

SEQ ID NO: 55352 - protein, 790 aa, Homo sapiens
MFSNSTGRLPGQPTEEIQQYKVLVHSQERELTQLREKLREGRDASRSLNEHLQALLTPDEPDKSQGQDLQEQLAEGCRLAQQLVQKLSPENDEDEDEDVQVEEDEKVLESSAPREVQKAEESKVPEDSLEECAITCSNSHGPCDSNQPHKNIKITFEEDKVNSSLVVDREYSHDECQDALNILPVPGPTSSATNVSMVVSAGPLSSEKAEMNILEINEKLRPQLAEKKQQFRSLKEKCFVTQVACFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGRHRWDQVKKEDQEATGPRLSRELLAEKEPEVLQDSLDRCYSTPSVYLGLTDSCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSTAC

SEQ ID NO: 55353 - protein, 77 aa, Homo sapiens
MDEIEKYQEVEEDQDPSCPRLSRELLAEKEPEVLQDSLDRCYSTPSGYLELPDLGQPYRSAVYSLEEQYLGLALDVD

SEQ ID NO: 55354 - protein, 77 aa, Homo sapiens
MDEIEKYQEVEEDQDPSCPRLSRELLAEKEPEVLQDSLDRWYSTPSGYLELPDLGQPYRSAVYSLEEQYLGLALDVD

SEQ ID NO: 55355 - protein, 77 aa, Homo sapiens; identical to SEQ ID NO: 55353

SEQ ID NO: 55356 - protein, 68 aa, Homo sapiens
EMQKAEEKEVPEDSLEECAITCSNSHGPYDSNQPHRKTKITFEEDKVDSTLIGSSSHVEWEDAVHIIP

SEQ ID NO: 55357 - protein, 3331 aa, Homo sapiens
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQQLVQKLSPENDEDEDEDVQVEEDEKVLESSAPREVQKAEESKVPEDSLEECAITCSNSHGPCDSNQPHKNIKITFEEDKVNSTVVVDRKSSHDECQDALNILPVPGPTSSATNVSMVVSAGPLSSEKAEMNILEINEKLRPQLAEKKQQFRSLKEKCFVTQLAGFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSSPREMQKAEESKVPEDSLEECAITCSNSHGPCDSNQPHKNIKITFEEDKVNSSLVVDREYSHDECQDALNILPVPGPTSSATNVSMVVSAGPLSSEKAEMNILEINEKLRPQLAEKKQQFRSLKEKCFVTQVACFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPERLASYQSYSSTFHSLEEQQVCMAVDIGSEYSIVKVIKLQFMAQSQAMPVPTWTDCHDIELKAGHRWDQVKKEDQEATGPRLSRELLAEKEPEVLQDSLDRCYSTPSVYLGLTDSCQPYRSAFYVLEQQRVGLAVDMDEIEKYQEVEEDQDPSCPRLSRELLAEKEPEVLQDSLDRWYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSGYLELPDLGQPYRSAVYSLEEQYLGLALDVDKIEKYQEVEEDQDPSCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKYQEVEEDQDPSCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRWYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLSRELLAEKEPEVLQDSLDRWYSTPSVYLGLTDPCQPCRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDRCYSTPSSCLEQPDSCQPYRSSFYALEEKHVGFSLDVGEIEKKGKGKKRRGRRSKKKRRRGRKEGEEDQNPPCPRLNSVLMEVEEPEVLQDSLDRCYSTPSMYFELPDSFQHYRSVFYSFEEQHITFALDMDNSFFTLTVTSLHLVFQMGVIFPQ

SEQ ID NO: 55358 - protein, 77 aa, Homo sapiens; identical to SEQ ID NO: 55353

SEQ ID NO: 55359 - protein, 838 aa, Homo sapiens
MVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQQLVQKLSPENDEDEDEDVQVEEDEKVLESSAPREVQKAEESKVPEDSLEECAITCSNSHGPCDSNQPHKNIKITFEEDKVNSSLVVDREYSHDECQDALNILPVPGPTSSATNVSMVVSAGPLSSEKAEMNILEINEKLRPQLAEKKQQFRSLKEKCFVTQVACFLAKQQNKYKYEECKDLIKSMLRNELQFKEEKLAEQLKQAEELRQYKVLVHSQERELTQLREKLREGRDASRSLNEHLQALLTPDEPDKSQGQDLQEQLAEGCRLAQHLVQKLSPENDNDDDEDVQVEVAEKVQKSSSPREMQKAEEKEVPEDSLEECAITCSNSHGPYDSNQPHRKPKSHLRKTKSTQLSLAHPLMLNGRMLYTLSQKMKVMMRKRKKKGQCLPGICRSLKRRKSPRSPGMKVIRLSQFLLKGHRWDQVKKEDQEATGPRLSRELLAEKEPEVLQDSLDRCYSTPSVYLGLTDSCQPYRSAFYVLEQQRVGLAVDMDEIEKYQEVEEDQDPSCPRLSRELLAEKEPEVLQDSLDRCYSTPSGYLELPDLGQPYRSAVYSLEEQYLGLALDVDRIKKDQEEEEDQGPPCPRLSRELLEVVEPEVLQDSLDVIQLLPVVLNSLTPASPTEVPFMHWRKNMLAFLLTWEKLKRRGRGRKEGEEDQRRKEEGEEKKGKKIKTHHAPGSTAC

SEQ ID NO: 55360 - protein, 95 aa, Homo sapiens
IAEIEKYQEVEEDQDPSCPRLSRELLAEKEPEVLQDSLDRWYSTPSGYLELPDLGQPYRSAVYSLEEQYLGLALDVDKIEKYQEVEEDQDPSCPR

SEQ ID NO: 55361 - protein, 77 aa, Homo sapiens; identical to SEQ ID NO: 55353

SEQ ID NO: 55362 - protein, 927 aa, Homo sapiens
  MOD_RES (1)..(1): Any amino acid
XDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVNMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGCLELTDSCQPYRSAFYILEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 55363 - protein, 921 aa, Homo sapiens
MLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVNMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYILEQQRVGLAVDMDEIEKYQEVEEDQDPSCPRLSGELLDEKEPEVLQESLDRCYSTPSGCLELTDSCQPYRSAFYILEQQRVGLAVDMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 55364 - protein, 269 aa, Homo sapiens
MDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNSMLMEVEEPEVLQDSLDICYSTPSMYFELPDSFQHYRSVFYSFEEEHISFALYVDNRFFTLTVTSLHLVFQMGVIFPQ

SEQ ID NO: 55365 - protein, 512 aa, Homo sapiens
  MOD_RES (1)..(1): Any amino acid
XYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVEVAEKVQKSSAPREMQKAEEKEVPEDSLEECAITCSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYKSYSSTFHSLEEQQVCMAVDIGRHRWDQVKKEDHEATGPRLSRELLDEKGPEVLQDSLDRCYSTPSGCLELTDSCQPYRSAFYVLEQQRVGLAVNMDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRS

SEQ ID NO: 55366 - protein, 188 aa, Homo sapiens
MDEIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCP

SEQ ID NO: 55367 - protein, 512 aa, Homo sapiens; identical to SEQ ID NO: 55365
  MOD_RES (1)..(1): Any amino acid

SEQ ID NO: 55368 - protein, 512 aa, Homo sapiens; identical to SEQ ID NO: 55365
  MOD_RES (1)..(1): Any amino acid

SEQ ID NO: 55369 - protein, 250 aa, Homo sapiens
EIEKYQEVEEDQDPSCPRLSRELLDEKEPEVLQDSLGRCYSTPSGYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSGELLDEKEPEVLQESLDRCYSTPSGCLELTDSCQPYRSAFYILEQQRVGLAVDMDGEYLSM

SEQ ID NO: 55370 - protein, 512 aa, Homo sapiens; identical to SEQ ID NO: 55365
  MOD_RES (1)..(1): Any amino acid

SEQ ID NO: 55371 - protein, 512 aa, Homo sapiens; identical to SEQ ID NO: 55365
  MOD_RES (1)..(1): Any amino acid

SEQ ID NO: 55372 - protein, 512 aa, Homo sapiens; identical to SEQ ID NO: 55365
  MOD_RES (1)..(1): Any amino acid

SEQ ID NO: 55373 - protein, 512 aa, Homo sapiens; identical to SEQ ID NO: 55365
  MOD_RES (1)..(1): Any amino acid

SEQ ID NO: 55374 - protein, 670 aa, Homo sapiens
MVVSAGPLSSEKAEMNILEINEKLRPQLAEKKQQFRNLKEKCFLTQLAGFLANRQKKYKYEECKDLIKFMLRNERQFKEEKLAEQLKQAEELRQYKVLVHAQERELTQLREKLREGRDASRSLNEHLQALLTPDEPDKSQGQDLQEQLAEGCRLTQHLVQKLSPENDNDDDEDVQVEVAEKVQKSSAPREMQKAEEKEVPEDSLEECAITCSNSHGPYDSNQPHKKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKEPEVLQDSLDRCYSTPSGCLELTDSCQPYRSAFYVLEQQRVGLAIDMDEIEKYQEVEEDQDPSCPRLSRELLDEKEPEVLQDSLDRCYSTPSDYLELPDLGQPYSSAVYSLEEQYLGLALDVDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEDDNPPCPRLYGVLMEVEEPEVLQDSLDRCYSTPSMYFEQPDSFQHYRSVFYSFEEEHISFALYVDNRFFTLTVTSLHLVFQMGVIFPQ

SEQ ID NO: 55375 - protein, 670 aa, Homo sapiens; identical to SEQ ID NO: 55374

SEQ ID NO: 55376 - protein, 670 aa, Homo sapiens [sequence omitted]

SEQ ID NO: 55377 - protein, 670 aa, Homo sapiens [sequence omitted]

SEQ ID NO: 55378 - protein, 841 aa, Homo sapiens
MVVSAGPWSSEKAEMNILEINEKLRPQLAENKQQFGNLKERCFVTQLAGFLANQQKKYNYEECKDLIKFMLRNERQFKEEKLAEQLKQAEELRQYKVLVHSQERELTQLREKLREGRDASRSLNEHLQALLTLDEPDKSQGQDLQEQLAEGCRLAQHLVQKLSPENDEDEDEDVQVEEAEKVQKSSAPREVQKTEESKVPEDSLEECAITCSNSHGPCDSNQPHKNIKITFEEDEVNSTLVVDRESSHDECQDALNILPVPGPTSSATNVSMVVSAGPLSSEKAEMNILEINEKLHPQLAEKKQQFRNLKERCFVTQLAGFLANQQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRS

SEQ ID NO: 55379 - protein, 4621 aa, Homo sapiens [sequence omitted]

SEQ ID NO: 55380 - protein, 259 aa, Homo sapiens
MVVSAGPWSSEKAEMNILEINEKLRPQLAENKQQFGNLKERCFVTQLAGFLANQQKKYNYEECKDLIKFMLRNERQFKEEKLAEQLKQAEELRQYKVLVHSQERELTQLREKLREGRDASRSLNEHLQALLTLDEPDKSQGQDLQEQLAEGCRLAQHLVQKLSPENDEDEDEDVQVEEAEKVQKSSAPREVQKTEESKVPEDSLEECAITCSNSHGPCDSNQPHKNIKITFEEDEVNSTLVVDRESSHDECQDALNILP

SEQ ID NO: 55381 - protein, 151 aa, Homo sapiens
LSRELLEVVEPEVLQDSLDRCYSTPSSCLEQPDSCQPYGSSFYALEEKHVGFSLDVGEIEKKGKGKKRRGRRSKKERRRGRKEGEEDQTPPCPRLSRELLDEKGPEVLQDSLDRCYSTPSGCLELTDSCQPYRSAFYVLEQQRVGLAVDMD

SEQ ID NO: 55382 - protein, 151 aa, Homo sapiens
LSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMD

SEQ ID NO: 55383 - protein, 151 aa, Homo sapiens
LSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRSYSTPSGCLELTDSCQPYRSAFYVLEQQRVGLAVDMD

SEQ ID NO: 55384 - protein, 151 aa, Homo sapiens; identical to SEQ ID NO: 55382

SEQ ID NO: 55385 - protein, 671 aa, Homo sapiens
MVVSAGPLSSEKAEMNILEINEKLHPQLAEKKQQFRNLKERCFVTQLAGFLANQQKKYKYEECKDLIKSMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDDEDVQVELAEKVQKSSAPREMQKAEEKEVPEDSQEECAITYSNSHGPYDSNQPHRKTKITFEEDKVDSTLIGSSSHVEWEDAVHIIPENESDDEEEEEKGPVSPRNLQESEEEEVPQESWDEGYSTLSIPPEMLASYQSYSSTFHSLEEQQVCMAVDIGRHRWDQVKKEDQEATGPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEEDQNPPCPRLNGVLMEVEEPEVLQDSLDGCYSTPSMYFELPDSFQHYRSVFYSFEEQHISFALYVDNRFFTLTVTSLHLVFQMGVIFPQ

SEQ ID NO: 55386 - protein, 157 aa, Homo sapiens
LSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDGEYLSM

SEQ ID NO: 55387 - protein, 226 aa, Homo sapiens
LSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDEIEKYQEVEEDQDPSCPRLSRELLDEKEPEVLQDSLDRCYSTPSGYLELPDLGQPYSSAVYSLEEQYLGLALDVD

SEQ ID NO: 55388 - protein, 269 aa, Homo sapiens
MDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKKRRRGRKEGEEDQNPPCPRLNGVLMEVEEPEVLQDSLDGCYSTPSMYFELPDSFQHYRSVFYSFEEQHISFALYVDNRFFTLTVTSLHLVFQMGVIFPQ

SEQ ID NO: 55389 - protein, 157 aa, Homo sapiens; identical to SEQ ID NO: 55386

SEQ ID NO: 55390 - protein, 174 aa, Homo sapiens
LSRELLEVVEPEVLQDSLDRCYSTPSSCLEQPDSCQPYGSSFYALEEKHVGFSLDVGEIEKKGKGKKRRGRRSKKKRRRGRKEGEEDQNPPCPRLNGVLMEVEEPEVLQDSLDGCYSTPSMYFELPDSFQHYRSVFYSFEEQHISFALYVDNRFFTLTVTSLHLVFQMGVIFPQ

SEQ ID NO: 55391 - protein, 151 aa, Homo sapiens; identical to SEQ ID NO: 55383

SEQ ID NO: 55392 - protein, 252 aa, Homo sapiens
MDEIEKYQEVEEDQDPSCPRLSRELLDEKEPEVLQDSLDRCYSTPSGYLELPDLGQPYSSAVYSLEEQYLGLALDVDRTKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLSRELLDEKGPEVLQDSLDRCYSTPSGCLELTDSCQPYRSAFYVLEQQRVGLAVDMDGEYLSM

SEQ ID NO: 55393 - protein, 577 aa, Homo sapiens
MVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 55394 - protein, 633 aa, Homo sapiens
MPLTPTVQGFQWTLRGPDVETSPFGAPRAASHGVGRHQELRDPTVPGPTSSATNVSMVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 55395 - protein, 621 aa, Homo sapiens
MPLTPTVQGFQWTLRGPDVETSPFGAPRAASHGVGRHQELRDPTVPGPTSSATNVSMVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRSSGRFCCLISVGYIFCHPCPAWLIRNLQESEEEEAPQESWDEGHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 55396 - protein, 353 aa, Homo sapiens
MVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQEKGGPRGHKSQAQQGAAG

SEQ ID NO: 55397 - protein, 555 aa, Homo sapiens
MVVSAGPWSGEKAEMNILEINKKSRPQLAENKQQFRNLKQKCLVTQVAYFLANRQNNYDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDN

SEQ ID NO: 55398 - protein, 563 aa, Homo sapiens
MPLTPTVQGFQWTLRGPDVETSPFGAPRAASHGVGRHQELRDPTDYEDCKDLIKSMLRDERLLTEEKLAEELGQAEELRQYKVLVHSQERELTQLREKLQEGRDASRSLNQHLQALLTPDEPDNSQGRDLREQLAEGCRLAQHLVQKLSPENDDDEDEDVKVEEAEKVQELYAPREVQKAEEKEVPEDSLEECAITCSNSHHPCESNQPYGNTRITFEEDQVDSTLIDSSSHDEWLDAVCIIPENESDHEQEEEKGPVSPRNLQESEEEEAPQESWDEGDWTLSIPPDMSASYQSDRSTFHSVEEQQVGLALDIGRHWCDQVKKEDQEATSPRLSRELLDEKEPEVLQDSLDRFYSTPFEYLELPDLCQPYRSDFYSLQEQHLGLALDLDRMKKDQEEEEDQGPPCPRLSRELPEVVEPEDLQDSLDRWYSTPFSYPELPDSCQPYGSCFYSLEEEHVGFSLDVDEIEKYQEGEEDQKPPCPRLNEVLMEAEEPEVLQDSLDRCYSTTSTYFQLHASFQQYRSAFYSFEEQDVSLALDVDNRFFTLTVIRHHLAFQMGVIFPH

SEQ ID NO: 55399 - protein, 638 aa, Homo sapiens
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHQSEVQVSQAQLEPSTLVPSCLRLQLDQGFHCGNGLAQRGLSSTTCSFSANADSGNQWPFQELVLEPSLGMKNPPQLEDDALEGSASNTQGRQVTGRIRASLVLILKTIRRRLPFSKWRLAFRFAGPHAESAEIPNTAGRTQRMAG

SEQ ID NO: 55400 - protein, 638 aa, Homo sapiens; identical to SEQ ID NO: 55399

SEQ ID NO: 55401 - protein, 573 aa, Homo sapiens
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRNRQSLEPGELTNLRDFLISPVVSHVANPGHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHQSEVQVSQAQLEPSTLVPSCLRLQLDQGFHCGNGLAQRGLSSTTCSFSANA

SEQ ID NO: 55402 - protein, 123 aa, Homo sapiens
MVVSADPLSSERAEMNILEINQELRSQLAESNQQFRDLKEKFLITQATAYSLANQLKKYSCLKYRNHLPPERCRRLKKRKSLRTHWRNVLSLVQIVTTLLTPTSLTGAPKSHLRNTKSTLLWL

SEQ ID NO: 55403 - protein, 667 aa, Homo sapiens
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRNRQSLEPGELTNLRDFLISPVVSHVANPGHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHRSEVQISQAQLEPSTLVPSCLRLQLDQGFHCGNGLAQRGLSSTTCSFSANADSGNQWPFQELVLEPSLGMKNPPQLEDDALEGSASNTQGRQVTGRIRASLVLILKTIRRRLPFSKWRLAFRFAGPHAESAEIPNTAERMQRMIG

SEQ ID NO: 55404 - protein, 573 aa, Homo sapiens
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRNRQSLEPGELTNLRDFLISPVVSHVANPGHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHRSEVQISQAQLEPSTLVPSCLRLQLDQGFHCGNGLAQRGLSSTTCSFSANA

SEQ ID NO: 55405 - protein, 638 aa, Homo sapiens
MVVSADPLSSERAEMNILEINQELRSQLAESNQQFRDLKEKFLITQATAYSLANQLKKYKCEEYKDIIDSVLRDELQSMEKLAEKLRQAEELRQYKALVHSQAKELTQLREKLREGRDASRWLNKHLKTLLTPDDPDKSQGQDLREQLAEGHRLAEHLVHKLSPENDEDEDEDEDDKDEEVEKVQESPAPREVQKTEEKEVPQDSLEECAVTCSNSHNPSNSNQPHRSTKITFKEHEVDSALVVESEHPHDEEEEALNIPPENQNDHEEEEGKAPVPPRHHDKSNSYRHREVSFLALDEQKVCSAQDVARDYSNPKWDETSLGFLEKQSDLEEVKGQETVAPRLSRGPLRVDKHEIPQESLDGCCLTPSILPDLTPSYHPYWSTLYSFEDKQVSLALVDKIKKDQEEIEDQSPPCPRLSQELPEVKEQEVPEDSVNEVYLTPSVHHDVSDCHQPYSSTLSSLEDQLACSALDVASPTEAACPQGTWSGDLSHHRSEVQISQAQLEPSTLVPSCLRLQLDQGFHCGNGLAQRGLSSTTCSFSANADSGNQWPFQELVLEPSLGMKNPPQLEDDALEGSASNTQGRQVTGRIRASLVLILKTIRRRLPFSKWRLAFRFAGPHAESAEIPNTAERMQRMIG

SEQ ID NO: 55406 - protein, 638 aa, Homo sapiens; identical to SEQ ID NO: 55405

SEQ ID NO: 55407 - protein, 207 aa, Homo sapiens
MLASYKSYSSTFHSLEEQQVCMAVDIGRHRWDQVKKEDQEATGPRLSRELLDEKGPEVLQDSLYRCYSTPSGCLELTDSCQPYRSAFYVLEQQRVGLAVDMDEIEKYQEVEEDQGRWEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 55408 - protein, 609 aa, Homo sapiens
PVPGPTSSATNVSMVVSAGPLSSEKAEMNILEINEKLRPQLAEKKQQFRNLKEKCFLTQLSGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDNEDVQVEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRNLQESEEEEVPQESWDEGYSTPSIPPEMLASYKSYSSTFHSLEEQQVCMAVDIGRHRWDQVKKEDQEATGPRLSRELLDEKGPEVLQDSLYRCYSTPSGYLELPDLGQPYSSAVYSLEEQYLGLALDLDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 55409 - protein, 683 aa, Homo sapiens
  MOD_RES (1)..(1): Any amino acid
XPGPTSSATNVSMVVSAGPLSSEKAEMNILEINEKLRPQLAEKKQQFRNLKEKCFLTQLSGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDNEDVQVEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRNLQESEEEEVPQESWDEGYSTPSIPPEMLASYKSYSSTFHSLEEQQVCMAVDIGRHRWDQVKKEDQEATGPRLSRELLDEKGPEVLQDSLYRCYSTPSGCLELTDSCQPYRSAFYVLEQQRVGLAVDMDEIEKYQEVEEDQDPSCPRLSRELLDEKEPEVLQDSLGRWYSTPSGYLELPDLGQPYSSAVYSLEEQYLGLALDLDRIKKDQEEEEDQGPPCPRLSRELLEVVEPEVLQDSLDRCYSTPSSCLEQPDSCQPYGSSFYALEEKHVGFSLDVGEIEKKGKGKKRRGRRSKKERRRGRKEGEEDQNPPCPRLNGVLMEVEEPEVLQDSLDGCYSTPSMYFELPDSFQHYRSVFYSFEEQHISFALYVDNRFFTLTVTSLHLVFQMEVIFPQ

SEQ ID NO: 55410 - protein, 607 aa, Homo sapiens
PVPGPTSSATNVSMVVSAGPLSSEKAEMNILEINEKLRPQLAEKKQQFRNLKEKCFLTQLSGFLANQQNKYKYEECKDLIKFMLRNERQFKEEKLAEQLKQAEELRQYKVLVHAQERELTQLREKLREGRDASRSLNEHLQALLTPDEPDKSQGQDLQEQLAEGCRLAQHLVQKLSPENDNDDNEDVQVEVAEKVQKSSAPREMQKAEEKEVPEDSLEECAITYSNSHGPYDSNQPHRKTKITFEEDKVDSTLIGSSSHVEREDAVHIIPENESDDEEEEEKGPVSPRNLQESEEEEVPQESWDEGYSTPSIPPEMLASYKSYSSTFHSLEEQQVCMAVDIGRHRWDQVKKEDQEATGPRLSRELLDEKGPEVLQDSLYRCYSTPSGCLELTDSCQPYRSAFYVLEQQRVGLAVDMDEIEKYQEVEEDQDPSCPRLSRELLDEKEPEVLQDSLGRWYSTPSGYLELPDLGQPYSSAVYSLEEQYLGLALDLDRIKKDQEEEEDQGPPCPRLSRELLEVVEPEVLQDSLDVIQLLPVVLNSLTPASPMEVPFMHWRKNMLAFLLTWEKLKRRGRGRKEGEEDQRRKEEGEEKKGKKIKTHHAPGSTAC

SEQ ID NO: 55411 - protein, 193 aa, Homo sapiens [sequence omitted]

SEQ ID NO: 55412 - protein, 193 aa, Homo sapiens [sequence omitted]

SEQ ID NO: 55413 - protein, 193 aa, Homo sapiens [sequence omitted]

SEQ ID NO: 55414 - protein, 193 aa, Homo sapiens [sequence omitted]

SEQ ID NO: 55415 - protein, 193 aa, Homo sapiens [sequence omitted]

SEQ ID NO: 55416 - protein, 1321 aa, Homo sapiens
MGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 55417 - protein, 772 aa, Homo sapiens
MPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 55418 - protein, 1335 aa, Homo sapiens
RPPRDASELGARSRMGAPFVWALGLLMLQMLLFVAGEQGTQDITDASERGLHMQKLGSGSVQAALAELVALPCLFTLQPRPSAARDAPRIKWTKVRTASGQRQDLPILVAKDNVVRVAKSWQGRVSLPSYPRRRANATLLLGPLRASDSGLYRCQVVRGIEDEQDLVPLEVTGVVFHYRSARDRYALTFAEAQEACRLSSAIIAAPRHLQAAFEDGFDNCDAGWLSDRTVRYPITQSRPGCYGDRSSLPGVRSYGRRNPQELYDVYCFARELGGEVFYVGPARRLTLAGARAQCRRQGAALASVGQLHLAWHEGLDQCDPGWLADGSVRYPIQTPRRRCGGPAPGVRTVYRFANRTGFPSPAERFDAYCFRAHHPTSQHGDLETPSSGDEGEILSAEGPPVRELEPTLEEEEVVTPDFQEPLVSSGEEETLILEEKQESQQTLSPTPGDPMLASWPTGEVWLSTVAPSPSDMGAGTAASSHTEVAPTDPMPRRRGRFKGLNGRYFQQQEPEPGLQGGMEASAQPPTSEAAVNQMEPPLAMAVTEMLGSGQSRSPWADLTNEVDMPGAGSAGGKSSPEPWLWPPTMVPPSISGHSRAPVLELEKAEGPSARPATPDLFWSPLEATVSAPSPAPWEAFPVATSPDLPMMAMLRGPKEWMLPHPTPISTEANRVEAHGEATATAPPSPAAETKVYSLPLSLTPTGQGGEAMPTTPESPRADFRETGETSPAQVNKAEHSSSSPWPSVNRNVAVGFVPTETATEPTGLRGIPGSESGVFDTAESPTSGLQATVDEVQDPWPSVYSKGLDASSPSAPLGSPGVFLVPKVTPNLEPWVATDEGPTVNPMDSTVTPAPSDASGIWEPGSQVFEEAESTTLSPQVALDTSIVTPLTTLEQGDKVGVPAMSTLGSSSSQPHPEPEDQVETQGTSGASVPPHQSSPLGKPAVPPGTPTAASVGESASVSSGEPTVPWDPSSTLLPVTLGIEDFELEVLAGSPGVESFWEEVASGEEPALPGTPMNAGAEEVHSDPCENNPCLHGGTCNANGTMYGCSCDQGFAGENCEIDIDDCLCSPCENGGTCIDEVNGFVCLCLPSYGGSFCEKDTEGCDRGWHKFQGHCYRYFAHRRAWEDAEKDCRRRSGHLTSVHSPEEHSFINSFGHENTWIGLNDRIVERDFQWTDNTGLQFENWRENQPDNFFAGGEDCVVMVAHESGRWNDVPCNYNLPYVCKKGTVLCGPPPAVENASLIGARKAKYNVHATVRYQCNEGFAQHHVATIRCRSNGKWDRPQIVCTKPRRSHRMRRHHHHHQHHHQHHHHKSRKERRKHKKHPTEDWEKDEGNFC

SEQ ID NO: 55419 - protein, 729 aa, Homo sapiens
MSCCDLAAAGQLGKASIMASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 55420 - protein, 729 aa, Homo sapiens; identical to SEQ ID NO: 55419

SEQ ID NO: 55421 - protein, 712 aa, Homo sapiens
MASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDLQAGLARILGSKLSSWQRNPALKLAARLAHACGSDWIPAGSSGSKFLALLVNLACVEVRLALEETGTEVKEDVVTACYALMELGIQECTRCEQSLLKEPQKVQLVSVMKEAIGAVIHYLLQVGSEKQKEPFVFASVRILGAWLAEETSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPALQGTPASRGFFAAAILFLSQSHVARATPGSDQAVLALSPEYEGIWADLQELWFLGMQAFTGCVPLLPWLAPAALRSRWPQELLQLLGSVSPNSVKPEMVAAYQGVLVELARANRLCREAMRLQAGEETASHYRMAALEQCLSEP

SEQ ID NO: 55422 - protein, 176 aa, Homo sapiens
MPHSFRYLAALQGTPASRGFFAAAILFLSQSHVARATPGSDQAVLALSPEYEGIWADLQELWFLGMQAFTGCVPLLPWLAPAALRSRWPQELLQLLGSQPQLCQARDGGRLSGCPGGAGAGQPAVPGGHEAAGGRGDGQPLPHGCLGAVPVRALRGVHRGQTQGRAEREGGRRHLP

SEQ ID NO: 55423 - protein, 193 aa, Homo sapiens
  MOD_RES (1)..(1): Any amino acid
XSSLRKEVCQLLPFLVRYAKTLYEEAEEANDLSQQVANLAISPTTPGPTWPGDALRLLLPGWCHLTVEDGPREILIKEGAPSLLCKYFLQQWELTSPGHDTSVLPDSVEIGLQTCCHIFLNLVVTAPGLIKRDACFTSLMNTLMTSLPALVQQQGRLLLAANVATLGLLMARLLSTSPGSISSQLPGAEHMPC

SEQ ID NO: 55424 - protein, 244 aa, Homo sapiens
MASDCEPALNQAEGRNPTLERYLGALREAKNDSEQFAALLLVTKAVKAGDIDAKTRRRIFDAVGFTFPNRLLTTKEAPDGCPDHVLRALGVALLACFCSDPELAAHPQVLNKIPILSTFLTARGDPDDAARRSMIDDTYQCLTAVAGTPRGPRHLIAGGTVSALCQAYLGHGYGFDQALALLVGLLAAAETQCWKEAEPDLLAVLRGLSEDFQKAEDASKFELCQLLPLFLPPTTVPPECYRDL

SEQ ID NO: 55425 - protein, 596 aa, Homo sapiens
MEPELAAQKQPRPRRRSRRASGLSTEGATGPSADTSGSELDGRCSLRRGSSFTFLTPGPNWDFTLKRKRREKDDDVVSLSSLDLKEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALSGGKRKETLV

SEQ ID NO: 55426 - protein, 160 aa, Homo sapiens
MVAHDETGGLLPIKRTIRVLDVNNQSFREQEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDA

SEQ ID NO: 55427 - protein, 542 aa, Homo sapiens
MVAHDETGGLLPIKRTIRVLDVNNQSFREQEEPSNKRVRPLARVTSLANLISPVRNGAVRRFGQTIQSFTLRGDHRSPASAQKFSSRSTVPTPAKRRSSALWSEMLDITMKESLTTREIRRQEAIYEMSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALSGGKRKETLV

SEQ ID NO: 55428 - protein, 160 aa, Homo sapiens; identical to SEQ ID NO: 55426

SEQ ID NO: 55429 - protein, 415 aa, Homo sapiens
MSRGEQDLIEDLKLARKAYHDPMLKLSIMSEEELTHIFGDLDSYIPLHEDLLTRIGEATKPDGTVEQIGHILVSWLPRLNAYRGYCSNQLAAKALLDQKKQDPRVQDFLQRCLESPFSRKLDLWSFLDIPRSRLVKYPLLLKEILKHTPKEHPDVQLLEDAILIIQGVLSDINLKKGESECQYYIDKLEYLDEKQRDPRIEASKVLLCHGELRSKSGHKLYIFLFQDILVLTRPVTRNERHSYQVYRQPIPVQELVLEDLQDGDVRMGGSFRGAFSNSEKAKNIFRIRFHDPSPAQSHTLQANDVFHKQQWFNCIRAAIAPFQSAGSPPELQGLPELHEECEGNHPSARKLTAQRRASTVSSVTQVEVDENAYRCGSGMQMAEDSKSLKTHQTQPGIRRARDKALSGGKRKETLV

SEQ ID NO: 55430 - protein, 1020 aa, Homo sapiens
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKSPEKAKSPEKAKTLDVKSPEAKTPAKEEARSPADKFPEKAKSPVKEEVKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 55431 - protein, 971 aa, Homo sapiens
MMSFGGADALLGAPFAPLHGGGSLHYALARKGGAGGTRSAAGSSSGFHSWTRTSVSSVSASPSRFRGAGAASSTDSLDTLSNGPEGCMVAVATSRSEKEQLQALNDRFAGYIDKVRQLEAHNRSLEGEAAALRQQQAGRSAMGELYEREVREMRGAVLRLGAARGQLRLEQEHLLEDIAHVRQRLDDEARQREEAEAAARALARFAQEAEAARVDLQKKAQALQEECGYLRRHHQEEVGELLGQIQGSGAAQAQMQAETRDALKCDVTSALREIRAQLEGHAVQSTLQSEEWFRVRLDRLSEAAKVNTDAMRSAQEEITEYRRQLQARTTELEALKSTKDSLERQRSELEDRHQADIASYQEAIQQLDAELRNTKWEMAAQLREYQDLLNVKMALDIEIAAYRKLLEGEECRIGFGPIPFSLPEGLPKIPSVSTHIKVKSEEKIKVVEKSEKETVIVEEQTEETQVTEEVTEEEEKEAKEEEGKEEEGGEEEEAEGGEEETKSPPAEEAASPEKEAKSPVKEEAKSPAEAKSPEKEEAKSPAEVKSPEKAKSPAKEEAKSPPEAKSPEKEEAKSPAEVKSPEKAKSPAKEEAKSPAEAKSPEKAKSPVKEEAKSPAEAKSPVKEEAKSPAEVKSPEKAKSPTKEEAKSPEKAKSPEKEEAKSPEKAKSPVKAEAKSPEKAKSPVKAEAKSPEKAKSPVKEEAKSPEKAKSPVKEEAKSPEKAKSPVKEEAKTPEKAKSPVKEEAKSPEKAKSPLKEDAKAPEKEIPKKEEVKSPVKEEEKPQEVKVKEPPKKAEEEKAPATPKTEEKKDSKKEEAPKKEAPKPKVEEKKEPAVEKPKESKVEAKKEEAEDKKKVPTPEKEAPAKVEVKEDAKPKEKTEVAKKEPDDAKAKEPSKPAEKKEAAPEKKDTKEEKAKKPEEKPKTEAKAKEDDKTLSKEPSKPKAEKAEKSSSTDQKDSKPPEKATEDKAAKGK

SEQ ID NO: 55432 - protein, 916 aa, Homo sapiens
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 55433 - protein, 540 aa, Homo sapiens
MARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVPKSPVEEKGKSPVPKSPVEEKGKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 55434 - protein, 877 aa, Homo sapiens
MSYTLDSLGNPSAYRRVTETRSSFSRVSGSPSSGFRSQSWSRGSPSTVSSSYKRSMLAPRLAYSSAMLSSAESSLDFSQSSSLLNGGSGPGGDYKLSRSNEKEQLQGLNDRFAGYIEKVHYLEQQNKEIEAEIQALRQKQASHAQLGDAYDQEIRELRATLEMVNHEKAQVQLDSDHLEEDIHRLKERFEEEARLRDDTEAAIRALRKDIEEASLVKVELDKKVQSLQDEVAFLRSNHEEEVADLLAQIQASHITVERKDYLKTDISTALKEIRSQLESHSDQNMHQAEEWFKCRYAKLTEAAEQNKEAIRSAKEEIAEYRRQLQSKSIELESVRGTKESLERQLSDIEERHNHDLSSYQDTIQQLENELRGTKWEMARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVSKSPVEEKAKSPVPKSPVEEAKSKAEVGKGEQKEEEEKEVKEAPKEEKVEKKEEKPKDVPEKKKAESPVKEEAVAEVVTITKSVKVHLEKETKEEGKPLQQEKEKEKAGGEGGSEEEGSDKGAKGSRKEDIAVNGEVEGKEEVEQETKEKGSGREEEKGVVTNGLDLSPADEKKGGDKSEEKVVVTKTVEKITSEGGDGATKYITKSVTVTQKVEEHEETFEEKLVSTKKVEKVTSHAIVKEVTQSD

SEQ ID NO: 55435 - protein, 356 aa, Homo sapiens
MTKSYSESGLMGEPQPQGPPSWTDECLSSQDEEHEADKKEDDLETMNAEEDSLRNGGEEEDEDEDLEEEEEEEEEDDDQKPKRRGPKKKKMTKARLERFKLRRMKANARERNRMHGLNAALDNLRKVVPCYSKTQKLSKIETLRLAKNYIWALSEILRSGKSPDLVSFVQTLCKGLSQPTTNLVAGCLQLNPRTFLPEQNQDMPPHLPTASASFPVHPYSYQSPGLPSPPYGTMDSSHVFHVKPPPHAYSAALEPFFESPLTDCTSPSFDGPLSPPLSINGNFSFKHEPSAEFEKNYAFTMHYPAATLAGAQSHGSIFSGTAAPRCEIPIDNIMSFDSHSHHERVMSAQLNAIFHD

SEQ ID NO: 55436 - protein, 382 aa, Homo sapiens
MLTRLFSEPGLLSDVPKFASWGDGEDDEPRSDKGDAPPPPPPAPGPGAPGPARAAKPVPLRGEEGTEATLAEVKEEGELGGEEEEEEEEEEGLDEAEGERPKKRGPKKRKMTKARLERSKLRRQKANARERNRMHDLNAALDNLRKVVPCYSKTQKLSKIETLRLAKNYIWALSEILRSGKRPDLVSYVQTLCKGLSQPTTNLVAGCLQLNSRNFLTEQGADGAGRFHGSGGPFAMHPYPYPCSRLAGAQCQAAGGLGGGAAHALRTHGYCAAYETLYAAAGGGGASPDYNSSEYEGPLSPPLCLNGNFSLKQDSSPDHEKSYHYSMHYSALPGSRPTGHGLVFGSSAVRGGVHSENLLSYDMHLHHDRGPMYEELNAFFHN

SEQ ID NO: 55437 - protein, 331 aa, Homo sapiens
MSKTFVKSKEMGELVNTPSWMDKGLGSQNEVKEEESRPGTYGMLSSLTEEHDSIEEEEEEEEDGEKPKRRGPKKKKMTKARLERFRARRVKANARERTRMHGLNDALDNLRRVMPCYSKTQKLSKIETLRLARNYIWALSEVLETGQTPEGKGFVEMLCKGLSQPTSNLVAGCLQLGPQSVLLEKHEDKSPICDSAISVHNFNYQSPGLPSPPYGHMETHLLHLKPQVFKSLGESSFGSHLPDCSTPPYEGPLTPPLSISGNFSLKQDGSPDLEKSYSFMPHYPSSSLSSGHVHSTPFQAGTPRYDVPIDMSYDSYPHHGIGTQLNTVFTE

SEQ ID NO: 55438 - protein, 337 aa, Homo sapiens
MLTLPFDESVVMPESQMCRKFSRECEDQKQIKKPESFSKQIVLRGKSIKRAPGEETEKEEEEEDREEEDENGLPRRRGLRKKKTTKLRLERVKFRRQEANARERNRMHGLNDALDNLRKVVPCYSKTQKLSKIETLRLAKNYIWALSEILRIGKRPDLLTFVQNLCKGLSQPTTNLVAGCLQLNARSFLMGQGGEAAHHTRSPYSTFYPPYHSPELTTPPGHGTLDNSKSMKPYNYCSAYESFYESTSPECASPQFEGPLSPPPINYNGIFSLKQEETLDYGKNYNYGMHYCAVPPRGPLGQGAMFRLPTDSHFPYDLHLRSQSLTMQDELNAVFHN

SEQ ID NO: 55439 - protein, 237 aa, Homo sapiens
MPARLETCISDLDCASSSGSDLSGFLTDEEDCARLQQAASASGPPAPARRGAPNISRASEVPGAQDDEQERRRRRGRTRVRSEALLHSLRRSRRVKANDRERNRMHNLNAALDALRSVLPSFPDDTKLTKIETLRFAYNYIWALAETLRLADQGLPGGGARERLLPPQCVPCLPGPPSPASDAESWGSGAAAASPLSDPSSPAASEDFTYRPGDPVFSFPSLPKDLLHTTPCFIPYH

SEQ ID NO: 55440 - protein, 214 aa, Homo sapiens
MTPQPSGAPTVQVTRETERSFPRASEDEVTCPTSAPPSPTRTRGNCAEAEEGGCRGAPRKLRARRGGRSRPKSELALSKQRRSRRKKANDRERNRMHNLNSALDALRGVLPTFPDDAKLTKIETLRFAHNYIWALTQTLRIADHSLYALEPPAPHCGELGSPGGSPGDWGSLYSPVSQAGSLSPAASLEERPGLLGATFSACLSPGSLAFSDFL

SEQ ID NO: 55441 - protein, 151 aa, Homo sapiens
MERPEPELIRQSWRAVSRSPLEHGTVLFARLFALEPDLLPLFQYNCRQFSSPEDCLSSPEFLDHIRKVMLVIDAAVTNVEDLSSLEEYLASLGRKHRAVGVKLSSFSTVGESLLYMLEKCLGPAFTPATRAAWSQLYGAVVQAMSRGWDGE

SEQ ID NO: 55442 - protein, 78 aa, Homo sapiens
MDCCTENACSKPDDDILDIPLDDPGANAAAAKIQASFRGHMARKKIKSGERGRKGPGPGGPGGAGVARGGAGGGPSGD

SEQ ID NO: 55443 - protein, 78 aa, Homo sapiens; identical to SEQ ID NO: 55442

SEQ ID NO: 55444 - protein, 78 aa, Homo sapiens; identical to SEQ ID NO: 55442

SEQ ID NO: 55445 - protein, 311 aa, Homo sapiens
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGQ

SEQ ID NO: 55446 - protein, 315 aa, Homo sapiens
MAALGVLESDLPSAVTLLKNLQEQVMAVTAQVKSLTQKVQAGAYPTEKGLSFLEVKDQLLLMYLMDLTHLILDKASGGSLQGHDAVLRLVEIRTVLEKLRPLDQKLKYQIDKLIKTAVTGSLSENDPLRFKPHPSNMMSKLSSEDEEEDEAEDDQSEASGKKSVKGVSKKYVPPRLVPVHYDETEAEREKKRLERAKRRALSSSVIRELKEQYSDAPEEIRDARHPHVTRQSQEDQHRINYEESMMVRLSVSKREKGRRKRANVMSSQLHSLTHFSDISALTGGTVHLDEDQNPIKKRKKIPQKGRKKKGFRRRR

SEQ ID NO: 55447 - protein, 823 aa, Homo sapiens
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 55448 - protein, 863 aa, Homo sapiens
MALPRCTWPNYVWRAVMACLVHRGLGAPLTLCMLGCLLQAGHVLSQKLDDVDPLVATNFGKIRGIKKELNNEILGPVIQFLGVPYAAPPTGERRFQPPEPPSPWSDIRNATQFAPVCPQNIIDGRLPEVMLPVWFTNNLDVVSSYVQDQSEDCLYLNIYVPTEDVKRISKECARKPGKKICRKGGPLTKKQTDDLGDNDGAEDEDIRDSGGPKPVMVYIHGGSYMEGTGNLYDGSVLASYGNVIVITVNYRLGVLGFLSTGDQAAKGNYGLLDLIQALRWTSENIGFFGGDPLRITVFGSGAGGSCVNLLTLSHYSEGNRWSNSTKGLFQRAIAQSGTALSSWAVSFQPAKYARMLATKVGCNVSDTVELVECLQKKPYKELVDQDIQPARYHIAFGPVIDGDVIPDDPQILMEQGEFLNYDIMLGVNQGEGLKFVENIVDSDDGISASDFDFAVSNFVDNLYGYPEGKDVLRETIKFMYTDWADRHNPETRRKTLLALFTDHQWVAPAVATADLHSNFGSPTYFYAFYHHCQTDQVPAWADAAHGDEVPYVLGIPMIGPTELFPCNFSKNDVMLSAVVMTYWTNFAKTGDPNQPVPQDTKFIHTKPNRFEEVAWTRYSQKDQLYLHIGLKPRVKEHYRANKVNLWLELVPHLHNLNDISQYTSTTTKVPSTDITFRPTRKNSVPVTSAFPTAKQDDPKQQPSPFSVDQRDYSTELSVTIAVGASLLFLNILAFAALYYKKDKRRHDVHRRCSPQRTTTNDLTHAQEEEIMSLQMKHTDLDHECESIHPHEVVLRTACPPDYTLAMRRSPDDVPLMTPNTITMIPNTIPGIQPLHTFNTFTGGQNNTLPHPHPHPHSHSTTRV

SEQ ID NO: 55449 - protein, 10 aa, Homo sapiens
MALPRCTWPN

SEQ ID NO: 55450 - protein, 13 aa, Homo sapiens
MALPRCTWPNYVW

SEQ ID NO: 55451 - protein, 823 aa, Homo sapiens; identical to SEQ ID NO: 55447

SEQ ID NO: 55452 - protein, 823 aa, Homo sapiens; identical to SEQ ID NO: 55447

SEQ ID NO: 55453 - protein, 835 aa, Homo sapiens
MWLLALCLVGLAGAQRGGGGPGGGAPGGPGLGLGSLGEERFPVVNTAYGRVRGVRRELNNEILGPVVQFLGVPYATPPLGARRFQPPEAPASWPGVRNATTLPPACPQNLHGALPAIMLPVWFTDNLEAAATYVQNQSEDCLYLNLYVPTEDGPLTKKRDEATLNPPDTDIRDPGKKPVMLFLHGGSYMEGTGNMFDGSVLAAYGNVIVATLNYRLGVLGFLSTGDQAAKGNYGLLDQIQALRWLSENIAHFGGDPERITIFGSGAGASCVNLLILSHHSEGLFQKAIAQSGTAISSWSVNYQPLKYTRLLAAKVGCDREDSAEAVECLRRKPSRELVDQDVQPARYHIAFGPVVDGDVVPDDPEILMQQGEFLNYDMLIGVNQGEGLKFVEDSAESEDGVSASAFDFTVSNFVDNLYGYPEGKDVLRETIKFMYTDWADRDNGEMRRKTLLALFTDHQWVAPAVATAKLHADYQSPVYFYTFYHHCQAEGRPEWADAAHGDELPYVFGVPMVGATDLFPCNFSKNDVMLSAVVMTYWTNFAKTGDPNQPVPQDTKFIHTKPNRFEEVVWSKFNSKEKQYLHIGLKPRVRDNYRANKVAFWLELVPHLHNLHTELFTTTTRLPPYATRWPPRPPAGAPGTRRPPPPATLPPEPEPEPGPRAYDRFPGDSRDYSTELSVTVAVGASLLFLNILAFAALYYKRDRRQELRCRRLSPPGGSGSGVPGGGPLLPAAGRELPPEEELVSLQLKRGGGVGADPAEALRPACPPDYTLALRRAPDDVPLLAPGALTLLPSGLGPPPPPPPPSLHPFGPFPPPPPTATSHNNTLPHPHSTTRV

SEQ ID NO: 55454 - protein, 848 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 55455 - protein, 828 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 55456 - protein, 513 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVML

SEQ ID NO: 55457 - protein, 808 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSNFVDNLYGYPEGKDTLRETIKFMYTDWADRDNPETRRKTLVALFTDHQWVEPSVVTADLHARYGSPTYFYAFYHHCQSLMKPAWSDAAHGDEVPYVFGVPMVGPTDLFPCNFSKNDVMLSAVVMTYWTNFAKTGDPNKPVPQDTKFIHTKANRFEEVAWSKYNPRDQLYLHIGLKPRVRDHYRATKVAFWKHLVPHLYNLHDMFHYTSTTTKVPPPDTTHSSHITRRPNGKTWSTKRPAISPAYSNENAQGSWNGDQDAGPLLVENPRDYSTELSVTIAVGASLLFLNVLAFAALYYRKDKRRQEPLRQPSPQRGAGAPELGAAPEEELAALQLGPTHHECEAGPPHDTLRLTALPDYTLTLRRSPDDIPLMTPNTITMIPNSLVGLQTLHPYNTFAAGFNSTGLPHSHSTTRV

SEQ ID NO: 55458 - protein, 351 aa, Homo sapiens
MLPVWFTANLDIVATYIQEPNEDCLYLNVYVPTEDGSGAKKQGEDLADNDGDEDEDIRDSGAKPVMVYIHGGSYMEGTGNMIDGSILASYGNVIVITLNYRVGVLGFLSTGDQAAKGNYGLLDQIQALRWVSENIAFFGGDPRRITVFGSGIGASCVSLLTLSHHSEGLFQRAIIQSGSALSSWAVNYQPVKYTSLLADKVGCNVLDTVDMVDCLRQKSAKELVEQDIQPARYHVAFGPVIDGDVIPDDPEILMEQGEFLNYDIMLGVNQGEGLKFVEGVVDPEDGVSGTDFDYSVSILWTICMAILRVRTPCERPSSSCIQTGQTVTTLRPAVKHWWHSSLTTSGWSPQW

SEQ ID NO: 55459 - protein, 256 aa, Homo sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGMQEARLCGSSKMFNYFKSPFTNLINFF

SEQ ID NO: 55460 - protein, 816 aa, Homo sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 55461 - protein, 816 aa, Homo sapiens; identical to SEQ ID NO: 55460

SEQ ID NO: 55462 - protein, 873 aa, Homo sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILAQNTLAHGNCKHRCQLHLQAPRDCKSAYPFRNEDEIRGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 55463 - protein, 648 aa, Homo sapiens
MVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 55464 - protein, 236 aa, Homo sapiens
  MOD_RES (1)..(1): Any amino acid
XNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGMQEARLCGSSKMFNYFKSPFTNLINFF

SEQ ID NO: 55465 - protein, 836 aa, Homo sapiens
MLRPQGLLWLPLLFTSVCVMLNSNVLLWITALAIKFTLIDSQAQYPVVNTNYGKIQGLRTPLPSEILGPVEQYLGVPYASPPTGERRFQPPESPSSWTGIRNATQFSAVCPQHLDERFLLHDMLPIWFTTSLDTLMTYVQDQNEDCLYLNIYVPMEDGTNIKRNADDITSNDHGEDKDIHEQNSKKPVMVYIHGGSYMEGTGNMIDGSILASYGNVIVITINYRLGILGFLSTGDQAAKGNYGLLDQIQALRWIEENVGAFGGDPKRVTIFGSGAGASCVSLLTLSHYSEGLFQKAIIQSGTALSSWAVNYQPAKYTRILADKVGCNMLDTTDMVECLKNKNYKELIQQTITPATYHIAFGPVIDGDVIPDDPQILMEQGEFLNYDIMLGVNQGEGLKFVDGIVDNEDGVTPNDFDFSVSNFVDNLYGYPEGKDTLRETIKFMYTDWADKENPETRRKTLVALFTDHQWVAPAVATADLHAQYGSPTYFYAFYHHCQSEMKPSWADSAHGDEVPYVFGIPMIGPTELFSCNFSKNDVMLSAVVMTYWTNFAKTGDPNQPVPQDTKFIHTKPNRFEEVAWSKYNPKDQLYLHIGLKPRVRDHYRATKVAFWLELVPHLHNLNEIFQYVSTTTKVPPPDMTSFPYGTRRSPAKIWPTTKRPAITPANNPKHSKDPHKTGPEDTTVLIETKRDYSTELSVTIAVGASLLFLNILAFAALYYKKDKRRHETHRHPSPQRNTTNDITHIQNEEIMSLQMKQLEHDHECESLQAHDTLRLTCPPDYTLTLRRSPDDIPFMTPNTITMIPNTLMGMQPLHTFKTFSGGQNSTNLPHGHSTTRV

SEQ ID NO: 55466 - protein, 607 aa, Homo sapiens
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASNMPNTAQKY

SEQ ID NO: 55467 - protein, 704 aa, Homo sapiens
MIARCLLAVRSLRRVGGSRILLRMTLGREVMSPLQAMSSYTVAGRNVLRWDLSPEQIKTRTEELIVQTKQVYDAVGMLGIEEVTYENCLQALADVEVKYIVERTMLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 55468 - protein, 600 aa, Homo sapiens
MLDFPQHVSSDKEVRAASTEADKRLSRFDIEMSMRGDIFERIVHLQETCDLGKIKPEARRYLEKSIKMGKRNGLHLPEQVQNEIKSMKKRMSELCIDFNKNLNEDDTFLVFSKAELGALPDDFIDSLEKTDDDKYKITLKYPHYFPVMKKCCIPETRRRMEMAFNTRCKEENTIILQQLLPLRTKVAKLLGYSTHADFVLEMNTAKSTSRVTAFLDDLSQKLKPLGEAEREFILNLKKKECKDRGFEYDGKINAWDLYYYMTQTEELKYSIDQEFLKEYFPIEVVTEGLLNTYQELLGLSFEQMTDAHVWNKSVTLYTVKDKATGEVLGQFYLDLYPREGKYNHAACFGLQPGCLLPDGSRMMAVAALVVNFSQPVAGRPSLLRHDEVRTYFHEFGHVMHQICAQTDFARFSGTNVETDFVEVPSQMLENWVWDVDSLRRLSKHYKDGSPIADDLLEKLVASRLVNTGLLTLRQIVLSKVDQSLHTNTSLDAASEYAKYCSEILGVAATPGTNMPATFGHLAGGYDGQYYGYLWSEVFSMDMFYSCFKKEGIMNPEVGMKYRNLILKPGGSLDGMDMLHNFLKREPNQKAFLMSRGLHAP

SEQ ID NO: 55469 - protein, 121 aa, Homo sapiens
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQYRRLLVQILQK

SEQ ID NO: 55470 - protein, 154 aa, Homo sapiens
MARRAGGARMFGSLLLFALLAAGVAPLSWDLPEPRSRASKIRVHSRGNLWATGHFMGKKSLEPSSPSPLGTAPHTSLRDQRLQLSHDLLGILLLKKALGVSLSRPAPQIQEAAGTNTAEMTPIMGQTQQRGLDCAHPGKVLNGTLLMAPSGCKS

SEQ ID NO: 55471 - protein, 390 aa, Homo sapiens
MPSKSLSNLSVTTGANESGSVPEGWERDFLPASDGTTTELVIRCVIPSLYLLIITVGLLGNIMLVKIFITNSAMRSVPNIFISNLAAGDLLLLLTCVPVDASRYFFDEWMFGKVGCKLIPVIQLTSVGVSVFTLTALSADRYRAIVNPMDMQTSGALLRTCVKAMGIWVVSVLLAVPEAVFSEVARISSLDNSSFTACIPYPQTDELHPKIHSVLIFLVYFLIPLAIISIYYYHIAKTLIKSAHNLPGEYNEHTKKQMETRKRLAKIVLVFVGCFIFCWFPNHILYMYRSFNYNEIDPSLGHMIVTLVARVLSFGNSCVNPFALYLLSESFRRHFNSQLCCGRKSYQERGTSYLLSSSAVRMTSLKSNAKNMVTNSVLLNGHSMKQEMAL

SEQ ID NO: 55472 - protein, 426 aa, Homo sapiens
MTPLCLNCSVLPGDLYPGGARNPMACNGSAARGHFDPEDLNLTDEALRLKYLGPQQTELFMPICATYLLIFVVGAVGNGLTCLVILRHKAMRTPTNYYLFSLAVSDLLVLLVGLPLELYEMWHNYPFLLGVGGCYFRTLLFEMVCLASVLNVTALSVERYVAVVHPLQARSMVTRAHVRRVLGAVWGLAMLCSLPNTSLHGIRQLHVPCRGPVPDSAVCMLVRPRALYNMVVQTTALLFFCLPMAIMSVLYLLIGLRLRRERLLLMQEAKGRGSAAARSRYTCRLQQHDRGRRQVTKMLFVLVVVFGICWAPFHADRVMWSVVSQWTDGLHLAFQHVHVISGIFFYLGSAANPVLYSLMSSRFRETFQEALCLGACCHRLRPRHSSHSLSRMTTGSTLCDVGSLGSWVHPLAGNDGPEAQQETDPS

SEQ ID NO: 55473 - protein, 415 aa, Homo sapiens
MSGMEKLQNASWIYQQKLEDPFQKHLNSTEEYLAFLCGPRRSHFFLPVSVVYVPIFVVGVIGNVLVCLVILQHQAMKTPTNYYLFSLAVSDLLVLLLGMPLEVYEMWRNYPFLFGPVGCYFKTALFETVCFASILSITTVSVERYVAILHPFRAKLQSTRRRALRILGIVWGFSVLFSLPNTSIHGIKFHYFPNGSLVPGSATCTVIKPMWIYNFIIQVTSFLFYLLPMTVISVLYYLMALRLKKDKSLEADEGNANIQRPCRKSVNKMLFVLVLVFAICWAPFHIDRLFFSFVEEWSESLAAVFNLVHVVSGVFFYLSSAVNPIIYNLLSRRFQAAFQNVISSFHKQWHSQHDPQLPPAQRNIFLTECHFVELTEDIGPQFPCQSSMHNSHLPAALSSEQMSRTNYQSFHFNKT

SEQ ID NO: 55474 - protein, 1874 aa, Homo sapiens
MLGSSVKSVQPEVELSSGGGDEGADEPRGAGRKAAAADGRGMLPKRAKAPGGGGGMAKASAAELKVFKSGSVDSRVPGGPPASNLRKQKSLTNLSFLTDSEKKLQLYEPEWSDDMAKAPKGLGKVGSKGREAPLMSKTLSKSEHSLFQAKGSPAGGAKTPLAPLAPNLGKPSRIPRGPYAEVKPLSKAPEAAVSEDGKSDDELLSSKAKAQKSSGPVPSAKGQEERAFLKVDPELVVTVLGDLEQLLFSQMLDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 55475 - protein, 1877 aa, Homo sapiens
MLGSSVKSVQPEVELSSGGGDEGADEPRGAGRKAAAADGRGMLPKRAKAPGGGGGMAKASAAELKVFKSGSVDSRVPGGPPASNLRKQKSLTNLSFLTDSEKKLQLYEPEWSDDMAKAPKGLGKVGSKGREAPLMSKTLSKSEHSLFQAKGSPAGGAKTPLAPLAPNLGKPSRIPRGPYAEVKPLSKAPEAAVSEDGKSDDELLSSKAKAQKSSGPVPSAKGQEERAFLKVDPELVVTVLGDLEQLLFSQMLDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWVYELRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 55476 - protein, 1869 aa, Homo sapiens
MLGSSVKSVQPEVELSSGGGDEGADEPRGAGRKAAAADGRGMLPKRAKAPGGGGGMAKASAAELKVFKSGSVDSRVPGGPPASNLRKQKSLTNLSFLTDSEKKLQLYEPEWSDDMAKAPKGLGKVGSKGREAPLMSKTLSKSEHSLFQAKGSPAGGAKTPLAPLAPNLGKPSRIPRGPYAEVKPLSKAPEAAVSEDGKSDDELLSSKAKAQKSSGPVPSAKGQEERAFLKVDPELVVTVLGDLEQLLFSQMLDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWVYELRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 55477 - protein, 1817 aa, Homo sapiens
MLGSSVKSVQPEVELSSGGGDEGADEPRGAGRKAAAADGRGMLPKRAKAPGGGGGMAKASAAELKVFKSGSVDSRVPGGPPASNLRKQKSLTNLSFLTDSEKKLQLYEPEWSDDMAKAPKGLGKVGSKGREAPLMSKTLSKSEHSLFQAKGSPAGGAKTPLAPLAPNLGKPSRIPRGPYAEVKPLSKAPEAAVSEDGKSDDELLSSKAKAQKSSGPVPSAKGQEERAFLKVDPELVVTVLGDLEQLLFSQMLDPESQRKRTVQNVLDLRQNLEETMSSLRGSQVTHSSLEMTCYDSDDANPRSVSSLSNRSSPLSWRYGQSSPRLQAGDAPSVGGSCRSEGTPAWYMHGERAHYSHTMPMRSPSKLSHISRLELVESLDSDEVDLKSGYMSDSDLMGKTMTEDDDITTGWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 55478 - protein, 260 aa, Homo sapiens
MHQQSCKDLQLYLSNLANQIDRETGIGDVPLVILLDDLSEAGSISELVNGALTCKYHKCPYIIGTTNQPVKMTPNHGLHLSFSRMLTFSNNVEPANGFLVRYLRRKLVESDSDINANKEELLRVLDWVPKLWYHLHTFLEKHSTSDFLIGSPCFFLSCPIGIEDFRTWFIDLWNNSIIPYLQEGAKDGIKVHGQKAAWEDPVEWVRDTLPWPSAQQDDSTPSSLDSDPLMAMLLKLQEAANYIESPDRETILDPNLQATL

SEQ ID NO: 55479 - protein, 730 aa, Homo sapiens
MEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSQIRKLRRELESSQEKVATLTSQLSANANLVAAFEQSLVNMTSRLRHLAETAEEKMEFRSCHPGWSALARSWLTANSASQDTELLDLRETIDFLKKKNSEAQAVIQGALNASETTPKELRIKRQNSSDSISSLNSITSHSSIGSSKDADA

SEQ ID NO: 55480 - protein, 1483 aa, Homo sapiens
MLHLPLPRSGRTVNFPRSWDESSSISSGLSDASDNLSSEEFNASSSLNSLPSTPTASRRNSTIVLRTDSEKRSLAESGLSWFSESEEKAPKKLEYDSGSLKMEPGTSKWRRERPESCDDSSKGGELKKPISLGHPGSLKKGKTPPVAVTSPITHTAQSALKVAGKPEGKATDKGKLAVKNTGLQRSSSDAGRDRLSDAKKPPSGIARPSTSGSFGYKKPPPATGTATVMQTGGSATLSKIQKSSGIPVKPVNGRKTSLDVSNSAEPGFLAPGARSNIQYRSLPRPAKSSSMSVTGGRGGPRPVSSSIDPSLLSTKQGGLTPSRLKEPTKVASGRTTPAPVNQTDREKEKAKAKAVALDSDNISLKSIGSPESTPKNQASHPTATKLAELPPTPLRATAKSFVKPPSLANLDKVNSNSLDLPSSSDTTHASKVPDLHATSSASGGPLPSCFTPSPAPILNINSASFSQGLELMSGFSVPKETRMYPKLSGLHRSMESLQMPMSLPSAFPSSTPVPTPPAPPAAPTEEETEELTWSGSPRAGQLDSNQRDRNTLPKKGLRYQLQSQEETKERRHSHTIGGLPESDDQSELPSPPALPMSLSAKGQLTNIVSPTAATTPRITRSNSIPTHEAAFELYSGSQMGSTLSLAERPKGMIRSGSFRDPTDDVHGSVLSLASSASSTYSSAEERMQSEQIRKLRRELESSQEKVATLTSQLSANANLVAAFEQSLVNMTSRLRHLAETAEEKDTELLDLRETIDFLKKKNSEAQAVIQGALNASETTPKELRIKRQNSSDSISSLNSITSHSSIGSSKDADAKKKKKKSWLRSSFNKAFSIKKGPKSASSYSDIEEIATPDSSAPSSPKLQHGSTETASPSIKSSTSSSVGTDVTEGPAHPAPHTRLFHANEEEEPEKKEVSELRSELWEKEMKLTDIRLEALNSAHQLDQLRETMHNMQLEVDLLKAENDRLKVAPGPSSGSTPGQVPGSSALSSPRRSLGLALTHSFGPSLADTDLSPMDGISTCGPKEEVTLRVVVRMPPQHIIKGDLKQQEFFLGCSKVSGKVDWKMLDEAVFQVFKDYISKMDPASTLGLSTESIHGYSISHVKRVLDAEPPEMPPCRRGVNNISVSLKGLKEKCVDSLVFETLIPKPMMQHYISLLLKHRRLVLSGPSGTGKTYLTNRLAEYLVERSGREVTEGIVSTFNMHQQSCKDLQLYLSNLANQIDRETGIGDVPLVILLDDLSEAGSISELVNGALTCKYHKCPYIIGTTNQPVKMTPNHGLHLSFRMLTFSNNVEPANGFLVRYLRRKLVESDSDINANKEELLRVLDWVPKLWYHLHTFLEKHSTSDFLIGPCFFLSCPIGIEDFRTWFIDLWNNSIIPYLQEGAKDGIKVHGQKAAWEDPVEWVRDTLPWPSAQQDQSKLYHLPPPTVGPHSIASPPEDRTVKDSTPSSLDSDPLMAMLLKLQEAANYIESPDRETILDPNLQATL

SEQ ID NO: 55481 - protein, 1493 aa, Homo sapiens
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 55482 - protein, 2429 aa, Homo sapiens
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 55483 - protein, 2432 aa, Homo sapiens
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 55484 - protein, 2488 aa, Homo sapiens
MPAILVASKMKSGLPKPVHSAAPILHVPPARAGPQPCYLKLGSKVEVSKTTYPSQIPLKSQVLQGLQEPAGEGLPLRKSGSVENGFDTQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSSASSKDSSQSKIIRFTLGQKKISRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEESWEKSSVDNFVSRLHSSLHFSLPLFHHARYELVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 55485 - protein, 2417 aa, Homo sapiens
MSVMLWRWEQNNTTMKLQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSSASSKDSSQSKIIRFTLGQKKISRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEESWEKSSVDNFVSRLHSSLHFSLPLFHHARYELVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 55486 - protein, 1493 aa, Homo sapiens; identical to SEQ ID NO: 55481

SEQ ID NO: 55487 - protein, 816 aa, Homo sapiens
MLWPRNLTSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSERYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDS

SEQ ID NO: 55488 - protein, 2419 aa, Homo sapiens
MAIDLYCGLACLWGIHEPRQIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSSASSKDSSQSKIIRFTLGQKKISRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEESWEKSSVDNFVSRLHSSLHFSLPLFHHARYELVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWVNELRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 55489 - protein, 2365 aa, Homo sapiens
MESVSESSQQQKRKPVIHGLEDQKRIYTDWANHYLAKSGHKRLIRDLQQDVTDGVLLAQIIQVVANEKIEDINGCPKNRSQMIENIDACLNFLAAKGINIQGLSAEEIRNGNLKAILGLFFSLSRYKQQQQQPQKQHLSSPLPPAVSQVAGAPSQCQAGTPQQQVPVTPQAPCQPHQPAPHQQSKAQAEMQSRLPGPTARVSAAGSEAKTRGGSTTANNRRSQSFNNYDKSKPVTSPPPPPSSHEKEPLASSASSHPGMSDNAPASLESGSSSTPTNCSTSSAIPQPGAATKPWRSKSLSVKHSATVSMLSVKPPGPEAPRPTPEAMKPAPNNQKSMLEKLKLFNSKGGSKAGEGPGSRDTSCERLETLPSFEESEELEAASRMLTTVGPASSSPKIALKGIAQRTFSRALTNKKSSLKGNEKEKEKQQREKDKEKSKDLAKRASVTERLDLKEEPKEDPSGAAVPEMPKKSSKIASFIPKGGKLNSAKKEPMAPSHSGIPKPGMKSMPGKSPSAPAPSKEGERSRSGKLSSGLPQQKPQLDGRHSSSSSSLASSEGKGPGGTTLNHSISSQTVSGSVGTTQTTGSNTVSVQLPQPQQQYNHPNTATVAPFLYRSQTDTEGNVTAESSSTGVSVEPSHFTKTGQPALEELTGEDPEARRLRTVKNIADLRQNLEETMSSLRGTQVTHSTLETTFDTNVTTEMSGRSILSLTGRPTPLSWRLGQSSPRLQAGDAPSMGNGYPPRANASRFINTESGRYVYSAPLRRQLASRGSSVCHVDVSDKAGDEMDLEGISMDAPGYMSDGDVLSKNIRTDDITSGYMTDGGLGLYTRRLNRLPDGMAVVRETLQRNTSLGLGDADSWDDSSSVSSGISDTIDNLSTDDINTSSSISSYANTPASSRKNLDVQTDAEKHSQVERNSLWSGDDVKKSDGGSDSGIKMEPGSKWRRNPSDVSDESDKSTSGKKNPVISQTGSWRRGMTAQVGITMPRTKPSAPAGALKTPGTGKTDDAKVSEKGRLSPKASQVKRSPSDAGRSSGDESKKPLPSSSRTPTANANSFGFKKQSGSAAGLAMITASGVTVTSRSATLGKIPKSSALVSRSAGRKSSMDGAQNQDDGYLALSSRTNLQYRSLPRPSKSNSRNGAGNRSSTSSIDSNISSKSAGLPVPKLREPSKTALGSSLPGLVNQTDKEKGISSDNESVASCNSVKVNPAAQPVSSPAQTSLQPGAKYPDVASPTLRRLFGGKPTKQVPIATAENMKNSVVISNPHATMTQQGNLDSPSGSGVLSSGSSSPLYSKNVDLNQSPLASSPSSAHSAPSNSLTWGTNASSSSAVSKDGLGFQSVSSLHTSCESIDISLSSGGVPSHNSSTGLIASSKDDSLTPFVRTNSVKTTLSESPLSSPAASPKFCRSTLPRKQDSDPHLDRNTLPKKGLRYTPTSQLRTQEDAKEWLRSHSAGGLQDTAANSPFSSGSSVTSPSGTRFNFSQLASPTTVTQMSLSNPTMLRTHSLSNADGQYDPYTDSRFRNSSMSLDEKSRTMSRSGSFRDGFEEVHGSSLSLVSSTSSVYSTPEEKCQSEIRKLRRELDASQEKVSALTTQLTANAHLVAAFEQSLGNMTIRLQSLTMTAEQKDSELNELRKTIELLKKQNAAAQAAINGVINTPELNCKGNGTAQSADLRIRRQHSSDSVSSINSATSHSSVGSNIESDSKKKKRKNWLRSSFKQAFGKKKSPKSASSHSDIEEMTDSSLPSSPKLPHNGSTGSTPLLRNSHSNSLISECMDSEAETVMQLRNELRDKEMKLTDIRLEALSSAHQLDQLREAMNRMQSEIEKLKAENDRLKSESQGSGCSRAPSQVSISASPRQSMGLSQHSLNLTESTSLDMLLDDTGECSARKEGGRHVKIVVSFQEEMKWKEDSRPHLFLIGCIGVSGKTKWDVLDGVVRRLFKEYIIHVDPVSQLGLNSDSVLGYSIGEIKRSNTSETPELLPCGYLVGENTTISVTVKGLAENSLDSLVFESLIPKPILQRYVSLLIEHRRIILSGPSGTGKTYLANRLSEYIVLREGRELTDGVIATFNVDHKSSKELRQYLSNLADQCNSENNAVDMPLVIILDNLHHVSSLGEIFNGLLNCKYHKCPYIIGTMNQATSSTPNLQLHHNFRWVLCANHTEPVKGFLGRFLRRKLMETEISGRVRNMELVKIIDWIPKVWHHLNRFLEAHSSSDVTIGPRLFLSCPIDVDGSRVWFTDLWNYSIIPYLLEAVREGLQLYGRRAPWEDPAKWVMDTYPWAASPQQHEWPPLLQLRPEDVGFDGYSMPREGSTSKQMPPSDAEGDPLMNMLMRLQEAANYSSPQSYDSDSNSNSHHDDILDSSLESTL

SEQ ID NO: 55490 - protein, 2363 aa, Homo sapiens
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRLFGAKAGGKSASAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSESMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEAGGSLEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 55491 - protein, 2186 aa, Homo sapiens
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEAGGSLEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 55492 - protein, 791 aa, Homo sapiens
MTSLHTSSESIDLPLSHHGSLSGLTTGTHEVQSLLMRTGSVRSTLSERYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAIQKPNIQQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWLRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEI

SEQ ID NO: 55493 - protein, 2385 aa, Homo sapiens
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRLFGAKAGGKSASAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSESMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASASPLVWPPKKRQNGPVIYKHRSRICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 55494 - protein, 2363 aa, Homo sapiens
MPVLGVASKLRQPAVGSKPVHTALPIPNLGTTGSQHCSSRPLELTETESSMLSCQLALKSTCEFGEKKPLQGKAKEKEDSKIYTDWANHYLAKSGHKRLIKDLQQDIADGVLLAEIIQIIANEKVEDINGCPRSQSQMIENVDVCLSFLAARGVNVQGLSAEEIRNGNLKAILGLFFSLSRYKQQQHHQQQYYQSLVELQQRVTHASPPSEASQAKTQQDMQSSLAARYATQSNHSGIATSQKKPTRLPGPSRVPAAGSSSKVQGASNLNRRSQSFNSIDKNKPPNYANGNEKDSSKGPQSSSGVNGNVQPPSTAGQPPASAIPSPSASKPWRSKSMNVKHSATSTMLTVKQSSTATSPTPSSDRLKPPVSEGVKTAPSGQKSMLEKFKLVNARTALRPPQPPSSGPSDGGKDDDAFSESGEMEGFNSGLNSGGSTNSSPKVSPKLAPPKAGSKNLSNKKSLLQPKEKEEKNRDKNKVCTEKPVKEEKDQVTEMAPKKTSKIASLIPKGSKTTAAKKESLIPSSSGIPKPGSKVPTVKQTISPGSTASKESEKFRTTKGSPSQSLSKPITMEKASASSCPAPLEGREAGQASPSGSCTMTVAQSSGQSTGNGAVQLPQQQQHSHPNTATVAPFIYRAHSENEGTALPSADSCTSPTKMDLSYSKTAKQCLEEISGEDPETRRMRTVKNIADLRQNLEETMSSLRGTQISHSTLETTFDSTVTTEVNGRTIPNLTSRPTPMTWRLGQACPRLQAGDAPSLGAGYPRSGTSRFIHTDPSRFMYTTPLRRAAVSRLGNMSQIDMSEKASSDLDMSSEVDVGGYMSDGDILGKSLRTDDINSGYMTDGGLNLYTRSLNRIPDTATSRDIIQRGVHDVTVDADSWDDSSSVSSGLSDTLDNISTDDLNTTSSVSSYSNITVPSRKNTQLRTDSEKRSTTDETWDSPEELKKPEEDFDSHGDAGGKWKTVSSGLPEDPEKAGQKASLSVSQTGSWRRGMSAQGGAPSRQKAGTSALKTPGKTDDAKASEKGKAPLKGSSLQRSPSDAGKSSGDEGKKPPSGIGRSTATSSFGFKKPSGVGSSAMITSSGATITSGSATLGKIPKSAAIGGKSNAGRKTSLDGSQNQDDVVLHVSSKTTLQYRSLPRPSKSSTSGIPGRGGHRSSTSSIDSNVSSKSAGATTSKLREPTKIGSGRSSPVTVNQTDKEKEKVAVSDSESVSLSGSPKSSPTSASACGAQGLRQPGSKYPDIASPTFRRLFGAKAGGKSASAPNTEGVKSSSVMPSPSTTLARQGSLESPSSGTGSMGSAGGLSGSSSPLFNKPSDLTTDVISLSHSLASSPASVHSFTSGGLVWAANMSSSSAGSKDTPSYQSMTSLHTSSESIDLPLSHHGSLSGLTTGTHEVQSLLMRTGSVRSTLSESMQLDRNTLPKKGLRYTPSSRQANQEEGKEWLRSHSTGGLQDTGNQSPLVSPSAMSSSAAGKYHFSNLVSPTNLSQFNLPGPSMMRSNSIPAQDSSFDLYDDSQLCGSATSLEERPRAISHSGSFRDSMEEVHGSSLSLVSSTSSLYSTAEEKAHSEQIHKLRRELVASQEKVATLTSQLSANAHLVAAFEKSLGNMTGRLQSLTMTAEQKESELIELRETIEMLKAQNSAAQAAIQGALNGPDHPPKDLRIRRQHSSESVSSINSATSHSSIGSGNDADSKKKKKKNWVNSRGSELRSSFKQAFGKKKSTKPPSSHSDIEELTDSSLPASPKLPHNAGDCGSASMKPSQSASAICECTEAEAEIILQLKSELREKELKLTDIRLEALSSAHHLDQIREAMNRMQNEIEILKAENDRLKAETGNTAKPTRPPSESSSSTSSSSSRQSLGLSLNNLNITEAVSSDILLDDAGDATGHKDGRSVKIIVSISKGYGRAKDQKSQAYLIGSIGVSGKTKWDVLDGVIRRLFKEYVFRIDTSTSLGLSSDCIASYCIGDLIRSHNLEVPELLPCGYLVGDNNIITVNLKGVEENSLDSFVFDTLIPKPITQRYFNLLMEHHRIILSGPSGTGKTYLANKLAEYVITKSGRKKTEDAIATFNVDHKSSKELQQYLANLAEQCSADNNGVELPVVIILDNLHHVGSLSDIFNGFLNCKYNKCPYIIGTMNQGVSSSPNLELHHNFRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 55495 - protein, 215 aa, Homo sapiens
MKRWVLCANHTEPVKGFLGRYLRRKLIEIEIERNIRNNDLVKIIDWIPKTWHHLNSFLETHSSSDVTIGPRLFLPCPMDVEGSRVWFMDLWNYSLVPYILEAVREGLQMYGKRTPWEDPSKWVLDTYPWSSATLPQESPALLQLRPEDVGYESCTSTKEATTSKHIPQTDTEGDPLMNMLMKLQEAANYSSTQSCDSESTSHHEDILDSSLESTL

SEQ ID NO: 55496 - protein, 190 aa, Homo sapiens [sequence omitted]

SEQ ID NO: 55497 - protein, 172 aa, Homo sapiens
MATITEKEVQQWYKGFIKDCPSGQLDAAGFQKIYKQFFPFGDPTKFATFVFNVFDENKDGRIEFSEFIQALSVTSRGTLDEKLRWAFKLYDLDNDGYITRNEMLDIVDAIYQMVGNTVELPEEENTPEKRVDRIFAMMDKNADGKLTLQEFQEGSKADPSIVQALSLYDGLV

SEQ ID NO: 55498 - protein, 1183 aa, Homo sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 55499 - protein, 1236 aa, Homo sapiens
MQLKIMPKKKRLSAGRVPLILFLCQMISALEVPLDQKSTEVMVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYRLFSFVSSASF

SEQ ID NO: 55500 - protein, 1192 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 55501 - protein, 1304 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 55502 - protein, 1308 aa, Homo sapiens
MQLKIMPKKKRLSAGRVPLILFLCQMISALEVPLDQKSTEVMVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKVQAVNPRISNLTAAAAETYANISWEYEGPEHVNFYVEYGVAGSKEEWRKEIVNGSRSFFGLKGLMPGTAYKVRVGAVGDSGFVSSEDVFETGPAMASRQVDIATQGWFIGLMCAVALLILILLIVCFIRRNKGGKYPVKEKEDAHADPEIQPMKEDDGTFGEYSSLKNDAEDHKPLKKGSRTPSDRTVKKEDSDDSLVDYGEGVNGQFNEDGSFIGQYSGKKEKEPAEGNESSEAPSPVNAMNSFV

SEQ ID NO: 55503 - protein, 1180 aa, Homo sapiens
MQLKIMPKKKRLSAGRVPLILFLCQMISALEVPLDQKSTEVMVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAMASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 55504 - protein, 431 aa, Homo sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNE

SEQ ID NO: 55505 - protein, 61 aa, Homo sapiens
MQLKIMPKKKRLSAGRVPLILFLCQMISALEVPLDPKLLEDLVQPPTITQQSPKDYIIDPR

SEQ ID NO: 55506 - protein, 106 aa, Homo sapiens
MQLKIMPKKKRLSAGRVPLILFLCQMISALEVPLDLVQPPTITQQSPKDYIIDPRENIVIQCEAKGKPPPSFSWTRNGTHFDIDKDPLVTMKPGTGTLIINIMSEG

SEQ ID NO: 55507 - protein, 1304 aa, Homo sapiens; identical to SEQ ID NO: 55501

SEQ ID NO: 55508 - protein, 148 aa, Homo sapiens
MASRQVDIATQGWFIGLMCAVALLILILLIVCFIRRNKGGKYPVKEKEDAHADPEIQPMKEDDGTFGEYSDAEDHKPLKKGSRTPSDRTVKKEDSDDSLVDYGEGVNGQFNEDGSFIGQYSGKKEKEPAEGNESSEAPSPVNAMNSFV

SEQ ID NO: 55509 - protein, 118 aa, Homo sapiens
MQLKIMPKKKRLSAGRVPLILFLCQMISALEVPLDPKLLEDLVQPPTITQQSPKDYIIDPRENIVIQCEAKGKPPPSFSWTRNGTHFDIDKDPLVTMKPGTGTLIINIMSEGKAETYE

SEQ ID NO: 55510 - protein, 771 aa, Homo sapiens [sequence omitted]

SEQ ID NO: 55511 - protein, 106 aa, Homo sapiens; identical to SEQ ID NO: 55506

SEQ ID NO: 55512 - protein, 1153 aa, Homo sapiens
MQLKIMPKKKRLSAGRVPLILFLCQMISALEVPLDQKSTEVMVQPPTITQQSPKDYIIDPRENIVIQCEAKGKPPPSFSWTRNGTHFDIDKDPLVTMKPGTGTLIINIMSEGKAETYEGVYQCTARNERGAAVSNNIVVRPSRSPLWTKEKLEPITLQSGQSLVLPCRPPIGLPPPIIFWMDNSFQRLPQSERVSQGLNGDLYFSNVLPEDTREDYICYARFNHTQTIQQKQPISVKVISVDELNDTIAANLSDTEFYGAKSSRERPPTFLTPEGNASNKEELRGNVLSLECIAEGLPTPIIYWAKEDGMLPKNRTVYKNFEKTLQIIHVSEADSGNYQCIAKNALGAIHHTISVRVKAAPYWITAPQNLVLSPGEDGTLICRANGNPKPRISWLTNGVPIEIAPDDPSRKIDGDTIIFSNVQERSSAVYQCNASNEYGYLLANAFVNVLAEPPRILTPANTLYQVIANRPALLDCAFFGSPLPTIEWFKGAKGSALHEDIYVLHENGTLEIPVAQKDSTGTYTCVARNKLGMAKNEVHLEIKDPTWIVKQPEYAVVQRGSMVSFECKVKHDHTLSLTVLWLKDNRELPSDERFTVDKDHLVVADVSDDDSGTYTCVANTTLDSVSASAVLSVVAPTPTPAPVYDVPNPPFDLELTDQLDKSVQLSWTPGDDNNSPITKFIIEYEDAMHKPGLWHHQTEVSGTQTTAQLKLSPYVNYSFRVMAVNSIGKSLPSEASEQYLTKASEPDKNPTAVEGLGSEPDNLVITWKPLNGFESNGPGLQYKVSWRQKDGDDEWTSVVVANVSKYIVSGTPTFVPYLIKVQALNDMGFAPEPAVVMGHSGEDLPMVAPGNVRVNVVNSTLAEVHWDPVPLKSIRGHLQGYRIYYWKTQSSSKRNRRHIEKKILTFQGSKTHGMLPGLEPFSHYTLNVRVVNGKGEGPASPDRVFNTPEGVPSAPSSLKIVNPTLDSLTLEWDPPSHPNGILTEYTLKYQPINSTHELGPLVDLKIPANKTRWTLKNLNFSTRYKFYFYAQTSAGSGSQITEEAVTTVDEAGILPPDVGAGKAMASRQVDIATQGWFIGLMCAVALLILILLIVCFIRRNKGGKYPVKEKEDAHADPEIQPMKEDDGTFGEYSDAEDHKPLKKGSRTPSDRTV

SEQ ID NO: 55513 - protein, 226 aa, Homo sapiens
MQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 55514 - protein, 354 aa, Homo sapiens
MDMMLLVQGACCSNQWLAAVLLSLCCLLPSCLPAGQSVDFPWAAVDNMMVRKGDTAVLRCYLEDGASKGAWLNRSSIIFAGGDKWSVDPRVSISTLNKRDYSLQIQNVDVTDDGPYTCSVQTQHTPRTMQVHLTVQVPPKIYDISNDMTVNEGTNVTLTCLATGKPEPSISWRHISPSAKPFENGQYLDIYGITRDQAGEYECSAENDVSFPDVRKVKVVVNFAPTIQEIKSGTVTPGRSGLIRCEGAGVPPPAFEWYKGEKKLFNGQQGIIIQNFSTRSILTVTNVTQEHFGNYTCVAANKLGTTNASLPLNPPSTAQYGITGSADVLFSCWYLVLTLSSFTSIFYLKNAILQ

SEQ ID NO: 55515 - protein, 308 aa, Homo sapiens [sequence omitted]

SEQ ID NO: 55516 - protein, 710 aa, Homo sapiens
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRMPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 55517 - protein, 618 aa, Homo sapiens
MELLAAAFSAACAVDHDSSTSESDARDSAAGHLPGSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 55518 - protein, 238 aa, Homo sapiens
MELLAAAFSAACAVDHDSSTSESDARDSAAGHLPGSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSER

SEQ ID NO: 55519 - protein, 433 aa, Homo sapiens
MFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 55520 - protein, 600 aa, Homo sapiens
MPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDLPEIRSSGVLEILQPEEIKLQEAMFELVTSEASYYKSLNLLVSHFMENERIRKILHPSEAHILFSNVLDVLAVSERFLLELEHRMEENIVISDVCDIVYRYAADHFSVYITYVSNQTYQERTYKQLLQEKAAFRELIAQLELDPKCRGLPFSSFLILPFQRITRLKLLVQNILKRVEERSERECTALDAHKELEMVVKACNEGVRKMSRTEQMISIQKKMEFKIKSVPIISHSRWLLKQGELQQMSGPKTSRTLRTKKLFHEIYLFLFNDLLVICRQIPGDKYQVFDSAPRGLLRVEELEDQGQTLANVFILRLLENADDREATYMLKASSQSEMKRWMTSLAPNRRTKFVSFTSRLLDCPQVQCVHPYVAQQPDELTLELADILNILDKTDDGWIFGERLHDQERGWFPSSMTEEILNPKIRSQNLKECFRVHKMDDPQRSQNKDRRKLGSRNRQ

SEQ ID NO: 55521 - protein, 234 aa, Homo sapiens
MTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDSCRGLRVAAVCGHSGWEREEPRGAPCALGQPRAQPSRGWPNSFGCLPASSQRGL

SEQ ID NO: 55522 - protein, 590 aa, Homo sapiens
MAAPYPGSGGGSEVKCVGGRGASVPWDFLPGLMVKAPSGPCLQAQRKEKSRNAARSRRGKENLEFFELAKLLPLPGAISSQLDKASIVRLSVTYLRLRRFAALGAPPWGLRAAGPPAGLAPGRRGPAALVSEVFEQHLGGHILQSLDGFVFALNQEGKFLYISETVSIYLGLSQVEMTGSSVFDYIHPGDHSEVLEQLGLRTPTPGPPTPPSVSSSSSSSSSLADTPEIEASLTKVPPSSLVQERSFFVRMKSTLTKRGLHVKASGYKVIHVTGRLRAHALGLVALGHTLPPAPLAELPLHGHMIVFRLSLGLTILACESRVSDHMDLGPSELVGRSCYQFVHGQDATRIRQSHVDLLDKGQVMTGYYRWLQRAGGFVWLQSVATVAGSGKSPGEHHVLWVSHVLSQAEGGQTPLDAFQLPASVACEEASSPGPEPTEPEPPTEGKQAAPAENEAPQTQGKRIKVEPGPRETKGSEDSGDEDPSSHPATPRPEFTSVIRAGVLKQDPVRPWGLAPPGDPPPTLLHAGFLPPVVRGLCTPGTIRYGPAELGLVYPHLQRLGPGPALPEAFYPPLGLPYPGPAGTRLPRKGD

SEQ ID NO: 55523 - protein, 824 aa, Homo sapiens
MDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNTLDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 55524 - protein, 889 aa, Homo sapiens
MYAYGFVGRCAPFPAEEGRTFDLSEELGRSVTREGTGTTRLNSEPVPLLCLPLLNCSRKNCIENLMDEDEKDRAKRASRNKSEKKRRDQFNVLIKELSSMLPGNTRKMDKTTVLEKVIGFLQKHNEVSAQTEICDIQQDWKPSFLSNEEFTQLMLEALDGFIIAVTTDGSIIYVSDSITPLLGHLPSDVMDQNLLNFLPEQEHSEVYKILSSHMLVTDSPSPEYLKSDSDLEFYCHLLRGSLNPKEFPTYEYIKFVGNFRSYNNVPSPSCNGFDNTLSRPCRVPLGKEVCFIATVRLATPQFLKEMCIVDEPLEEFTSRHSLEWKFLFLDHRAPPIIGYLPFEVLGTSGYDYYHIDDLELLARCHQHLMQFGKGKSCCYRFLTKGQQWIWLQTHYYITYHQWNSKPEFIVCTHSVVSYADVRVERRQELALEDPPSEALHSSALKDKGSSLEPRQHFNTLDVGASGLNTSHSPSASSRSSHKSSHTAMSEPTSTPTKLMAEASTPALPRSATLPQELPVPGLSQAATMPAPLPSPSSCDLTQQLLPQTVLQSTPAPMAQFSAQFSMFQTIKDQLEQRTRILQANIRWQQEELHKIQEQLCLVQDSNVQMFLQQPAVSLSFSSTQRPEAQQQLQQRSAAVTQPQLGAGPQLPGQISSAQVTSQHLLRESSVISTQGPKPMRSSQLMQSSGRSGSSLVSPFSSATAALPPSLNLTTPASTSQDASQCQPSPDFSHDRQLRLLLSQPIQPMMPGSCDARQPSEVSRTGRQVKYAQSQTVFQNPDAHPANSSSAPMPVLLMGQAVLHPSFPASQPSPLQPAQARQQPPQHYLQVQAPTSLHSEQQDSLLLSTYSQQPGTLGYPQPPPAQPQPLRPPRRVSSLSESSGLQQPPR

SEQ ID NO: 55525 - protein, 257 aa, Homo sapiens
MAPTKPSFQQDPSRRERITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVVCFPPASDQFLL

SEQ ID NO: 55526 - protein, 901 aa, Homo sapiens
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 55527 - protein, 933 aa, Homo sapiens
MAPTKPSFQQDPSRRERITAQHPLPNQSECRKIYRYDGIYCESTYQNLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 55528 - protein, 920 aa, Homo sapiens
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKGIQMWKSELCMRKTPCEVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 55529 - protein, 153 aa, Homo sapiens
MRDFANQGDPPWNLRMEGPPPNTSVKGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVVCFPPASDQFLL

SEQ ID NO: 55530 - protein, 903 aa, Homo sapiens
MAPTKPSFQQDPSRRERLQALRKEKSRDAARSRRGKENFEFYELAKLLPLPAAITSQLDKASIIRLTISYLKMRDFANQGDPPWNLRMEGPPPNTSVKVIGAQRRRSPSALAIEVFEAHLGSHILQSLDGFVFALNQEGKFLYISETVSIYLGLSQVELTGSSVFDYVHPGDHVEMAEQLGMKLPPGRGLLSQGTAEDGASSASSSSQSETPEPVESTSPSLLTTDNTLERSFFIRMKSTLTKRGVHIKSSGYKVIHITGRLRLRVSLSHGRTVPSQIMGLVVVAHALPPPTINEVRIDCHMFVTRVNMDLNIIYCENRISDYMDLTPVDIVGKRCYHFIHAEDVEGIRHSHLDLLNKGQCVTKYYRWMQKNGGYIWIQSSATIAINAKNANEKNIIWVNYLLSNPEYKDTPMDIAQLPHLPEKTSESSETSDSESDSKDTSGITEDNENSKSDEKGNQSENSEDPEPDRKKSGNACDNDMNCNDDGHSSSNPDSRDSDDSFEHSDFENPKAGEDGFGALGAMQIKVERYVESESDLRLQNCESLTSDSAKDSDSAGEAGAQASSKHQKRKKRRKRQKGGSASRRRLSSASSPGGLDAGLVEPPRLLSSPNSASVLKIKTEISEPINFDNDSSIWNYPPNREISRNESPYSMTKPPSSEHFPSPQGGGGGGGGGGGLHVAIPDSVLTPPGADGAAARKTQFGASATAALAPVASDPLSPPLSASPRDKHPGNGGGGGGGGGGAGGGGPSASNSLLYTGDLEALQRLQAGNVVLPLVHRVTGTLAATSTAAQRVYTTGTIRYAPAEVTLAMQSNLLPNAHAVNFVDVNSPGFGLDPKTPMEMLYHHVHRLNMSGPFGGAVSAASLTQMPAGNVFTTAEGLFSTLPFPVYSNGIHAAQTLERKED

SEQ ID NO: 55531 - protein, 802 aa, Homo sapiens
MYRSTKGASKARRDQINAEIRNLKELLPLAEADKVRLSYLHIMSLACIYTRKGVFFAGGTPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPGPASLFLAMFQSRHAKDLALLDISESVLIYLGFERSELLCKSWYGLLHPEDLAHASAQHYRLLAESGDIQAEMVVRLQAKTGGWAWIYCLLYSEGPEGPITANNYPISDMEAWSLRQQLNSEDTQAAYVLGTPTMLPSFPENILSQEECSSTNPLFTAALGAPRSTSFPSAPELSVVSASEELPRPSKELDFSYLTFPSGPEPSLQAELSKDLVCTPPYTPHQPGGCAFLFSLHEPFQTHLPTPSSTLQEQLTPSTATFSDQLTPSSATFPDPLTSPLQGQLTETSVRSYEDQLTPCTSTFPDQLLPSTATFPEPLGSPAHEQLTPPSTAFQAHLDSPSQTFPEQLSPNPTKTYFAQEGCSFLYEKLPPSPSSPGNGDCTLLALAQLRGPLSVDVPLVPEGLLTPEASPVKQSFFHYSEKEQNEIDRLIQQISQLAQGMDRPFSAEAGTGGLEPLGGLEPLDSNLSLSGAGPPVLSLDLKPWKCQELDFLADPDNMFLEETPVEDIFMDLSTPDPSEEWGSGDPEAEGPGGAPSPCNNLSPEDHSFLEDLATYETAFETGVSAFPYDGFTDELHQLQSQVQDSFHEDGSGGEPTF

SEQ ID NO: 55532 - protein, 234 aa, Homo sapiens
MYRSTKGASKARRDQINAEIRNLKELLPLAEADKVRLSYLHIMSLACIYTRKGVFFAGGTPLAGPTGLLSAQELEDIVAALPGFLLVFTAEGKLLYLSESVSEHLGHSMVDLVAQGDSIYDIIDPADHLTVRQQLTLPSALDTDRLFRCRFNTSKSLRRQSAGNKLVLIRGRFHAHPPGAYWAGNPVFTAFCAPLEPRPRPGPGPGPGPASLFLAMFQSRHAKDLALLDISESG

SEQ ID NO: 55533 - protein, 432 aa, Homo sapiens
MPAGRAARTCALLALCLLGAGAQDFGPTRFICTSVPVDADMCAASVAAGGAEELRSSVLQLRETVLQQKETILSQKETIRELTAKLGRCESQSTLDPGAGEARAGGGRKQPGSGKNTMGDLSRTPAAETLSQLGQTLQSLKTRLENLEQYSRLNSSSQTNSLKDLLQSKIDELERQVLSRVNTLEEGKGGPRNDTEERVKIETALTSLHQRISELEKGQKDNRPGDKFQLTFPLRTNYMYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 55534 - protein, 194 aa, Homo sapiens
MYAKVKKSLPEMYAFTVCMWLKSSATPGVGTPFSYAVPGQANELVLIEWGNNPMEILINDKVAKLPFVINDGKWHHICVTWTTRDGVWEAYQDGTQGGSGENLAPYHPIKPQGVLVLGQEQDTLGGGFDATQAFVGELAHFNIWDRKLTPGEVYNLATCSTKALSGNVIAWAESHIEIYGGATKWTFEACRQIN

SEQ ID NO: 55535 - protein, 431 aa, Homo sapiens
MLALLAASVALAVAAGAQDSPAPGSRFVCTALPPEAVHAGCPLPAMPMQGGAQSPEEELRAAVLQLRETVVQQKETLGAQREAIRELTGKLARCEGLAGGKARGAGATGKDTMGDLPRDPGHVVEQLSRSLQTLKDRLESLEHQLRANVSNAGLPGDFREVLQQRLGELERQLLRKVAELEDEKSLLHNETSAHRQKTESTLNALLQRVTELERGNSAFKSPDAFKVSLPLRTNYLYGKIKKTLPELYAFTICLWLRSSASPGIGTPFSYAVPGQANEIVLIEWGNNPIELLINDKVAQLPLFVSDGKWHHICVTWTTRDGMWEAFQDGEKLGTGENLAPWHPIKPGGVLILGQEQDTVGGRFDATQAFVGELSQFNIWDRVLRAQEIVNIANCSTNMPGNIIPWVDNNVDVFGGASKWPVETCEERLLDL

SEQ ID NO: 55536 - protein, 81 aa, Homo sapiens
MAAVAAASAELLIIGWYIFRVLLQVFLECCIYWVGFAFRNPPGTQPIARSEVFRYSLQKLAYTVSRTGRQVLGERRQRAPN

SEQ ID NO: 55537 - protein, 54 aa, Homo sapiens
MAAVAAASAELLIIGWYIFRVLLQVFRYSLQKLAYTVSRTGRQVLGERRQRAPN

SEQ ID NO: 55538 - protein, 89 aa, Homo sapiens
MISSVKLNLILVLSLSTMHVFWCYPVPSSKVSGKSDYFLILLNSCPTRLDRSKELAFLKPILEKMFVKRSFRNGVGTGMKKTSFQRAKS

SEQ ID NO: 55539 - protein, 174 aa, Homo sapiens
VVLLYASTYVLVSLSIDRYHAIVYPMKVLIVIAWSLSFLFSIPTLIIFGKRTLSNGEVQCWALWPDDSYWTPYMTIVAFLGSLITFICCWSPYFLFDILDNFNLLPDTQERFYASVIIQNLPALNSAINPLIYCVFSSSISFPCREQRSQDSRMTFRERTERHEMQILSKPEFI

SEQ ID NO: 55540 - protein, 377 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCRVIRLRQLQEAALMLCPQRENWKGTWPGVPSWALPR

SEQ ID NO: 55541 - protein, 371 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 55542 - protein, 390 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVVLLYASTYVLVSLSIDRYHAIVYPMKFLQGEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCRANSSVYLLACDVSVLWALVLTSEKESCESWRRKGAKITGFQNDVPGEN

SEQ ID NO: 55543 - protein, 305 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITEKQARVLIVIAWSLSFLFSIPTLIIFGKRTLSNGEVQCWALWPDDSYWTPYMTIVAFLVYFIPLTIISIMYGIVIRTIWIKSKTYETVISNCSDGKLCSSYNRGLISKAKIKAIKYSIIIILAFICCWSPYFLFDILDNFNLLPDTQERFYASVIIQNLPALNSAINPLIYCVFSSSISFPCREQRSQDSRMTFRERTERHEMQILSKPEFI

SEQ ID NO: 55544 - protein, 143 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITDSFTGLVNILTDINWRFTGDFTAPDLVCRVVRYLQVMVMKLFHIQKMNME

SEQ ID NO: 55545 - protein, 94 aa, Homo sapiens
MPANFTEGSFDSSGTGQTLDSSPVACTETVTFTEVVEGKEWGSFYYSFKTEQLITLWVLFVFTIVGNSVVLFSTWRRKKKSRMTFFVTQLAITV

SEQ ID NO: 55546 - protein, 97 aa, Homo sapiens
MLGNKRLGLSGLTLALSLLVCLGALAEAYPSKPDNPGEDAPAEDMARYYSALRHYINLITRQRYGKRSSPETLISDLLMRESTENVPRTRLEDPAMW

SEQ ID NO: 55547 - protein, 97 aa, Homo sapiens; identical to SEQ ID NO: 55546

SEQ ID NO: 55548 - protein, 97 aa, Homo sapiens; identical to SEQ ID NO: 55546

SEQ ID NO: 55549 - protein, 384 aa, Homo sapiens
MNSTLFSQVENHSVHSNFSEKNAQLLAFENDDCHLPLAMIFTLALAYGAVIILGVSGNLALIIIILKQKEMRNVTNILIVNLSFSDLLVAIMCLPFTFVYTLMDHWVFGEAMCKLNPFVQCVSITVSIFSLVLIAVERHQLIINPRGWRPNNRHAYVGIAVIWVLAVASSLPFLIYQVMTDEPFQNVTLDAYKDKYVCFDQFPSDSHRLSYTTLLLVLQYFGPLCFIFICYFKIYIRLKRRNNMMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 55550 - protein, 61 aa, Homo sapiens
MNSTLFSQVENHSVHSNFSEKNAQLLAFENDDCHLPLAMIFTLALAYGAVIILGVSGNLAL

SEQ ID NO: 55551 - protein, 141 aa, Homo sapiens
MMDKMRDNKYRSSETKRINIMLLSIVVAFAVCWLPLTIFNTVFDWNHQIIATCNHNLLFLLCHLTAMISTCVNPIFYGFLNKNFQRDLQFFFNFCDFRSRDDDYETIAMSTMHTDVSKTSLKQASPVAFKKINNNDDNEKI

SEQ ID NO: 55552 - protein, 25 aa, Homo sapiens
MNSTLFSQVENHSVHSNFSEKNAQL

SEQ ID NO: 55553 - protein, 60 aa, Homo sapiens
MNSTLFSQVENHSVHSNFSEKNAQLLAFENDDCHLPLAMIFTLALAYGAVIILGVSGNLA

SEQ ID NO: 55554 - protein, 381 aa, Homo sapiens
MGPIGAEADENQTVEEMKVEQYGPQTTPRGELVPDPEPELIDSTKLIEVQVVLILAYCSIILLGVIGNSLVIHVVIKFKSMRTVTNFFIANLAVADLLVNTLCLPFTLTYTLMGEWKMGPVLCHLVPYAQGLAVQVSTITLTVIALDRHRCIVYHLESKISKRISFLIIGLAWGISALLASPLAIFREYSLIEIIPDFEIVACTEKWPGEEKSIYGTVYSLSSLLILYVLPLGIISFSYTRIWSKLKNHVSPGAANDHYHQRRQKTTKMLVCVVVVFAVSWLPLHAFQLAVDIDSQVLDLKEYKLIFTVFHIIAMCSTFANPLLYGWMNSNYRKAFLSAFRCEQRLDAIHSEVSVTFKAKKNLEVRKNSGPNDSFTEATNV

SEQ ID NO: 55555 - protein, 381 aa, Homo sapiens; identical to SEQ ID NO: 55554

SEQ ID NO: 55556 - protein, 445 aa, Homo sapiens
MDLELDEYYNKTLATENNTAATRNSDFPVWDDYKSSVDDLQYFLIGLYTFVSLLGFMGNLLILMALMKKRNQKTTVNFLIGNLAFSDILVVLFCSPFTLTSVLLDQWMFGKVMCHIMPFLQCVSVLVSTLILISIAIVRYHMIKHPISNNLTANHGYFLIATVWTLGFAICSPLPVFHSLVELQETFGSALLSSRYLCVESWPSDSYRIAFTISLLLVQYILPLVCLTVSHTSVCRSISCGLSNKENRLEENEMINLTLHPSKKSGPQVKLSGSHKWSYSFIKKHRRRYSKKTACVLPAPERPSQENHSRILPENFGSVRSQLSSSSKFIPGVPTCFEIKPEENSDVHELRVKRSVTRIKKRSRSVFYRLTILILVFAVSWMPLHLFHVVTDFNDNLISNRHFKLVYCICHLLGMMSCCLNPILYGFLNNGIKADLVSLIHCLHM

SEQ ID NO: 55557 - protein, 445 aa, Homo sapiens; identical to SEQ ID NO: 55556

SEQ ID NO: 55558 - protein, 445 aa, Homo sapiens; identical to SEQ ID NO: 55556

SEQ ID NO: 55559 - protein, 328 aa, Homo sapiens
MDNASFSEPWPANASGPDPALSCSNASTLAPLPAPLAVAVPVVYAVICAVGLAGNSAVLYVLLRAPRMKTVTNLFILNLAIADELFTLVLPINIADFLLRQWPFGELMCKLIVAIDQYNTFSSLYFLTVMSADRYLVVLATAESRRVAGRTYSAARAVSLAVWGIVTLVVLPFAVFARLDDEQGRRQCVLVFPQPEAFWWRASRLYTLVLGFAIPVSTICVLYTTLLCRLHAMRLDSHAKALERAKKRVTFLVVAILAVCLLCWTPYHLSTVVALTTDLPQTPLVIAISYFITSLSYANSCLNPFLYAFLDASFRRNLRQLITCRAAA

SEQ ID NO: 55560 - protein, 532 aa, Homo sapiens
MLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHSYSQDAADACDIDEIEEVPTTSHRLSRHDKAVQRFCLIGSLSKHESEYNTTRV

SEQ ID NO: 55561 - protein, 533 aa, Homo sapiens
MIHGRSVLHIVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPDPDFKDLGALKPLPACEFEMGGSEGIVESIQIMKEGKATASEAVDCKWYIRAPPRSKIYLRFLDYEMQNSNECKRNFVAVYDGSSSVEDLKAKFCSTVANDVMLRTGLGVIRMWADEGSRNSRFQMLFTSFQEPPCEGNTFFCHSNMCINNTLVCNGLQNCVYPWDENHCKEKRKTSLLDQLTNTSGTVIGVTSCIVIILIIISVIVQIKQPRKKYVQRKSDFDQTVFQEVFEPPHYELCTLRGTGATADFADVADDFENYHKLRRSSSKCIHDHHCGSQLSSTKGSRSNLSTRDASILTEMPTQPGKPLIPPMNRRNILVMKHSYSQDAADACDIDEIEEVPTTSHRLSRHDKAVQRFCLIGSLSKHESEYNTTRV

SEQ ID NO: 55562 - protein, 156 aa, Homo sapiens
MLAEPFPKVVASLIILHLSGATKKGTEKQTTSETQKSVQCGTWTKHAEGGIFTSPNYPSKYPPDRECIYIIEAAPRQCIELYFDEKYSIEPSWECKFDHIEVRDGPFGFSPIIGRFCGQQNPPVIKSSGRFLWIKFFADGELESMGFSARYNFTPE

SEQ ID NO: 55563 - protein, 533 aa, Homo sapiens; identical to SEQ ID NO: 55561

SEQ ID NO: 55564 - protein, 338 aa, Homo sapiens
MSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYEWCGATWPHSGLSWEFWLKLSSLW

SEQ ID NO: 55565 - protein, 398 aa, Homo sapiens
MSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 55566 - protein, 282 aa, Homo sapiens
MSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 55567 - protein, 193 aa, Homo sapiens
MSGSSLPSALALSLLLVSGSLLPGPGAAQNAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDDDEPAGPMKTNSTNNHKDKNLRQRNTN

SEQ ID NO: 55568 - protein, 394 aa, Homo sapiens
MSGSSLPSALALSLLLVSGSLLPGPGAAQNAGFVKSPMSETKLTGDAFELYCDVVGSPTPEIQWWYAEVNRAESFRQLWDGARKRRVTVNTAYGSNGVSVLRITRLTLEDSGTYECRASNDPKRNDLRQNPSITWIRAQATISVLQKPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPDVPPRKTNSTNNHKDKNLRQRNTN

SEQ ID NO: 55569 - protein, 170 aa, Homo sapiens
MMAGMKIQLVCMLLLAFSSWSLCSDSEEEMKALEADFLTNMHTSKISKAHVPSWKMTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 55570 - protein, 115 aa, Homo sapiens
MTLLNVCSLVNNLNSPAEETGEVHEEELVARRKLPTALDGFSLEAMLTIYQLHKICHSRAFQHWELIQEDILDTGNDKNGKEEVIKRKIPYILKRQLYENKPRRPYILKRDSYYY

SEQ ID NO: 55571 - protein, 95 aa, Homo sapiens
MMAGMKIQLVCMLLLAFSSWSLCSDSEEEMKALEADFLTNMHTSKLIQEDILDTGNDKNGKEEVIKRKIPYILKRQLYENKPRRPYILKRDSYYY

SEQ ID NO: 55572 - protein, 418 aa, Homo sapiens
MRLNSSAPGTPGTPAADPFQRAQAGLEEALLAPGFGNASGNASERVLAAPSSELDVNTDIYSKVLVTAVYLALFVVGTVGNTVTAFTLARKKSLQSLQSTVHYHLGSLALSDLLTLLLAMPVELYNFIWVHHPWAFGDAGCRGYYFLRDACTYATALNVASLSVERYLAICHPFKAKTLMSRSRTKKFISAIWLASALLAVPMLFTMGEQNRSADGQHAGGLVCTPTIHTATVKVVIQVNTFMSFIFPMVVISVLNTIIANKLTVMVRQAAEQGQVCTVGGEHSTFSMAIEPGRVQALRHGVRVLRAVVIAFVVCWLPYHVRRLMFCYISDEQWTPFLYDFYHYFYMVTNALFYVSSTINPILYNLVSANFRHIFLATLACLCPVWRRRRKRPAFSRKADSVSSNHTLSSNATRETLY

SEQ ID NO: 55573 - protein, 316 aa, Homo sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGETVL

SEQ ID NO: 55574 - protein, 344 aa, Homo sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 55575 - protein, 344 aa, Homo sapiens
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFGPGAVSEVSNGTSRRAGCVWLLPLLVLHLLLKF

SEQ ID NO: 55576 - protein, 346 aa, Homo sapiens
MNGKRNGEGGKRWKWKGTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 55577 - protein, 355 aa, Homo sapiens
MKTIQPKMHNSISWAIFTGLAALCLFQGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 55578 - protein, 355 aa, Homo sapiens
MGVCGYLFLPWKCLVVVSLRLLFLVPTGVPVRSGDATFPKAMDNVTVRQGESATLRCTIDNRVTRVAWLNRSTILYAGNDKWCLDPRVVLLSNTQTQYSIEIQNVDVYDEGPYTCSVQTDNHPKTSRVHLIVQVSPKIVEISSDISINEGNNISLTCIATGRPEPTVTWRHISPKAVGFVSEDEYLEIQGITREQSGDYECSASNDVAAPVVRRVKVTVNYPPYISEAKGTGVPVGQKGTLQCEASAVPSAEFQWYKDDKRLIEGKKGVKVENRPFLSKLIFFNVSEHDYGNYTCVASNKLGHTNASIMLFEVKTTALTPWKGPGAVSEVSNGTSRRAGCVWLLPLLVLHLLLKF

SEQ ID NO: 55579 - protein, 790 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 55580 - protein, 760 aa, Homo sapiens
MKEAALICLAPSVPPILTVKSWDTMQLRAARSRCTNLLAASYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 55581 - protein, 796 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVTSDLNRKNVTCWAENDVGRAEVSVQVNVSFPASVQLHTAVEMHHWCIPFSVDGQPAPSLRWLFNGSVLNETSFIFTEFLEPAANETVRHGCLRLNQPTHVNNGNYTLLAANPFGQASASIMAAFMDNPFEFNPEDPIPVSFSPVDTNSTSGDPVEKKDETPFGVSVAVGLAVFACLFLSTLLLVLNKCGRRNKFGINRPAVLAPEDGLAMSLHFMTLGGSSLSPTEGKGSGLQGHIIENPQYFSDACVHHIKRRDIVLKWELGEGAFGKVFLAECHNLLPEQDKMLVAVKALKEASESARQDFQREAELLTMLQHQHIVRFFGVCTEGRPLLMVFEYMRHGDLNRFLRSHGPDAKLLAGGEDVAPGPLGLGQLLAVASQVAAGMVYLAGLHFVHRDLATRNCLVGQGLVVKIGDFGMSRDIYSTDYYRVGGRTMLPIRWMPPESILYRKFTTESDVWSFGVVLWEIFTYGKQPWYQLSNTEAIDCITQGRELERPRACPPEVYAIMRGCWQREPQQRHSIKDVHARLQALAQAPPVYLDVLG

SEQ ID NO: 55582 - protein, 838 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 55583 - protein, 553 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKDFSWFGFGKVKSRQGVGPASVISNDDDSASPLHHISNGSNTPSSSEGGPDAVIIGMTKIPVIENPQYFGITNSQLKPDTWPRGSPKTA

SEQ ID NO: 55584 - protein, 822 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTFVQHIKRHNIVLKRELGEGAFGKVFLAECYNLCPEQDKILVAVKTLKDASDNARKDFHREAELLTNLQHEHIVKFYGVCVEGDPLIMVFEYMKHGDLNKFLRAHGPDAVLMAEGNPPTELTQSQMLHIAQQIAAGMVYLASQHFVHRDLATRNCLVGENLLVKIGDFGMSRDVYSTDYYRVGGHTMLPIRWMPPESIMYRKFTTESDVWSLGVVLWEIFTYGKQPWYQLSNNEVIECITQGRVLQRPRTCPQEVYELMLGCWQREPHMRKNIKGIHTLLQNLAKASPVYLDILG

SEQ ID NO: 55585 - protein, 477 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGFVLFHKIPLDG

SEQ ID NO: 55586 - protein, 537 aa, Homo sapiens
MSSWIRWHGPAMARLWGFCWLVVGFWRAAFACPTSCKCSASRIWCSDPSPGIVAFPRLEPNSVDPENITEIFIANQKRLEIINEDDVEAYVGLRNLTIVDSGLKFVAHKAFLKNSNLQHINFTRNKLTSLSRKHFRHLDLSELILVGNPFTCSCDIMWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGPASVISNDDDSASPLHHISNGSNTPSSSEGGPDAVIIGMTKIPVIENPQYFGITNSQLKPDTWPRGSPKTA

SEQ ID NO: 55587 - protein, 822 aa, Homo sapiens; identical to SEQ ID NO: 55584

SEQ ID NO: 55588 - protein, 838 aa, Homo sapiens; identical to SEQ ID NO: 55582

SEQ ID NO: 55589 - protein, 321 aa, Homo sapiens
MWIKTLQEAKSSPDTQDLYCLNESSKNIPLANLQIPNCGLPSANLAAPNLTVEEGKSITLSCSVAGDPVPNMYWDVGNLVSKHMNETSHTQGSLRITNISSDDSGKQISCVAENLVGEDQDSVNLTVHFAPTITFLESPTSDHHWCIPFTVKGNPKPALQWFYNGAILNESKYICTKIHVTNHTEYHGCLQLDNPTHMNNGDYTLIAKNEYGKDEKQISAHFMGWPGIDDGANPNYPDVIYEDYGTAANDIGDTTNRSNEIPSTDVTDKTGREHLSVYAVVVIASVVGFCLLVMLFLLKLARHSKFGMKGFVLFHKIPLDG

SEQ ID NO: 55590 - protein, 477 aa, Homo sapiens; identical to SEQ ID NO: 55585

SEQ ID NO: 55591 - protein, 612 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTWVFSNIDNHGILNLKDNRDHLVPSTHYIYEEPEVQSGEVSYPRSHGFREIMLNPISLPGHSKPLNHGIYVEDVNVYFSKGRHGF

SEQ ID NO: 55592 - protein, 137 aa, Homo sapiens
MTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLSSISSPKSHQQG

SEQ ID NO: 55593 - protein, 825 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 55594 - protein, 831 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPVDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 55595 - protein, 839 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRLFNPSGNDFCIWCEVGGHTMLPIRWMPPESIMYRKFTTESDVWSFGVILWEIFTYGKQPWFQLSNTEVIECITQGRVLERPRVCPKEVYDVMLGCWQREPQQRLNIKEIYKILHALGKATPIYLDILG

SEQ ID NO: 55596 - protein, 825 aa, Homo sapiens; identical to SEQ ID NO: 55593

SEQ ID NO: 55597 - protein, 612 aa, Homo sapiens; identical to SEQ ID NO: 55591

SEQ ID NO: 55598 - protein, 617 aa, Homo sapiens
MELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQTNLNWTNVHAINLTLVNVTSEDNGFTLTCIAENVVGMSNASVALTVYYPPRVVSLEEPELRLEHCIEFVVRGNPPPTLHWLHNGQPLRESKIIHVEYYQEGEISEGCLLFNKPTHYNNGNYTLIAKNPLGTANQTINGHFLKEPFPESTDNFILFDEVSPTPPITVTHKPEEDTFGVSIAVGLAAFACVLLVVLFVMINKYGRRSKFGMKGPVAVISGEEDSASPLHHINHGITTPSSLDAGPDTVVIGMTRIPVIENPQYFRQGHNCHKPDTYVQHIKRRDIVLKRELGEGAFGKVFLAECYNLSPTKDKMLVAVKALKDPTLAARKDFQREAELLTNLQHEHIVKFYGVCGDGDPLIMVFEYMKHGDLNKFLRAHGPDAMILVDGQPRQAKGELGLSQMLHIASQIASGMVYLASQHFVHRDLATRNCLVGANLLVKIGDFGMSRDVYSTDYYRVVQA

SEQ ID NO: 55599 - protein, 257 aa, Homo sapiens
MSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 55600 - protein, 270 aa, Homo sapiens
MVTFATILQVNKVMSILFYVIFLAYLRGIQGNNMDQRSLPEDSLNSLIIKLIQADILKNKLSKQMVDVKENYQSTLPKAEAPREPERGGPAKSAFQPVIAMDTELLRQQRRYNSPRVLLSDSTPLEPPPLYLMEDYVGSPVVANRTSRRKRYAEHKSHRGEYSVCDSESLWVTDKSSAIDIRGHQVTVLGEIKTGNSPVKQYFYETRCKEARPVKNGCRGIDDKHWNSQCKTSQTYVRALTSENNKLVGWRWIRIDTSCVCALSRKIGRT

SEQ ID NO: 55601 - protein, 210 aa, Homo sapiens
MLPLPSCSLPILLLFLLPSVPIESQPPPSTLPPFLAPEWDLLSPRVVLSRGAPAGPPLLFLLEAGAFRESAGAPANRSRRGVSETAPASRRGELAVCDAVSGWVTDRRTAVDLRGREVEVLGEVPAAGGSPLRQYFFETRCKADNAEEGGPGAGGGGCRGVDRRHWVSECKAKQSYVRALTADAQGRVGWRWIRIDTACVCTLLSRTGRA

SEQ ID NO: 55602 - protein, 197 aa, Homo sapiens
MQRWKAAALASVLCSSVLSIWMCREGLLLSHRLGPALVPLHRLPRTLDARIARLAQYRALLQGAPDAMELRELTPWAGRPPGPRRRAGPRRRRARARLGARPCGLRELEVRVSELGLGYASDETVLFRYCAGACEAAARVYDLGLRRLRQRRRLRRERVRAQPCCRPTAYEDEVSFLDAHSRYHTVHELSARECACV

SEQ ID NO: 55603 - protein, 440 aa, Homo sapiens
MSSCRGQKVAGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 55604 - protein, 408 aa, Homo sapiens
MRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASAKIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 55605 - protein, 448 aa, Homo sapiens
MSSCRGQKVAGGLRVVSPFPLCQPAGEPSQGKMRSSCVLLTALVALAAYYVYIPLPGSVSDPWKLMLLDATFRGAQQVSNLIHYLGLSHHLLALNFIIVSFGKKSAWSSAQVKVTDTDFDGVEVRVFEGPPKPEEPLKRSVVYIHGGGWALASASASWSPSDEIRYYDELCTAMAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 55606 - protein, 275 aa, Homo sapiens
MAEELNAVIVSIEYRLVPKVYFPEQIHDVVRATKYFLKPEVLQKYMVDPGRICISGDSAGGNLAAALGQQFTQDASLKNKLKLQALIYPVLQALDFNTPSYQQNVNTPILPRYVMVKYWVDYFKGNYDFVQAMIVNNHTSLDVEEAAAVRARLNWTSLLPASFTKNYKPVVQTTGNARIVQELPQLLDARSAPLIADQAVLQLLPKTYILTCEHDVLRDDGIMYAKRLESAGVEVTLDHFEDGFHGCMIFTSWPTNFSVGIRTRNSYIKWLDQNL

SEQ ID NO: 55607 - protein, 917 aa, Homo sapiens
MAFIRKKQQEQQLQLYSKERFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 55608 - protein, 948 aa, Homo sapiens
MTGQARFHRGAEACRAIRQCRSRRPRAAHPEGRAGSGRGSRHASPGVRRGGFSLLLLNLEEYYFEQHRANHILHKGSHHERKIRGSLKICSKSVIFEPDSISQPIIKIPLRDCIKIGKHGENGANRHFTKAKSGGISLIFSQVYFIKEHNVVAPYKIERGKMEYVFELDVPGKVEDVVETLLQLHRASCLDKLGDQTAMITAILQSRLARTSFDKNRFQNISEKLHMECKAEMVTPLVTNPGHVCITDTNLYFQPLNGYPKPVVQITLQDVRRIYKRRHGLMPLGLEVFCTEDDLCSDIYLKFYEPQDRDDLYFYIATYLEHHVAEHTAESYMLQWQRGHLSNYQYLLHLNNLADRSCNDLSQYPVFPWIIHDYSSSELDLSNPGTFRDLSKPVGALNKERLERLLTRYQEMPEPKFMYGSHYSSPGYVLFYLVRIAPEYMLCLQNGRFDNADRMFNSIAETWKNCLDGATDFKELIPEFYGDDVSFLVNSLKLDLGKRQGGQMVDDVELPPWASSPEDFLQKSKDALESNYVSEHLHEWIDLIFGYKQKGSDAVGAHNVFHPLTYEGGVDLNSIQDPDEKVAMLTQILEFGQTPKQLFVTPHPRRITPKFKSLSQTSSYNASMADSPGEESFEDLTEESKTLAWNNITKLQLHEHYKIHKEAVTGITVSRNGSSVFTTSQDSTLKMFSKESKMLQRSISFSNMALSSCLLLPGDATVITSSWDNNVYFYSIAFGRRQDTLMGHDDAVSKICWHDNRLYSASWDSTVKVWSGVPAEMPGTKRHHFDLLAELEHDVSVDTISLNAASTLLVSGTKEGTVNIWDLTTATLMHQIPCHSGIVCDTAFSPDSRHVLSTGTDGCLNVIDVQTGMLISSMTSDEPQRCFVWDGNSVLSGSQSGELLVWDLLGAKISERIQGHTGAVTCIWMNEQCSSIITGGEDRQIIFWKLQY

SEQ ID NO: 55609 - protein, 390 aa, Homo sapiens
MGDTFIRHIALLGFEKRFVPSQHYVYMFLVKWQDLSEKVVYRRFTEIYEFHKTLKEMFPIEAGAINPENRIIPHLPAPKWFDGQRAAENRQGTLTEYCGTLMSLPTKISRCPHLLDFFKVRPDDLKLPTDNQTKKPETYLMPKDGKSTATDITGPIILQTYRAIANYEKTSGSEMALSTGDVVEVVEKSESGWWFCQMKAKRGWIPASFLEPLDSPDETEDPEPNYAGEPYVAIKAYTAVEGDEVSLLEGEAVEVIHKLLDGWWVIRKDDVTGYFPSMYLQKSGQDVSQAQRQIKRGAPPRRSSIRNAHSIHQRSRKRLSQDAYRRNSVRFLQQRRRQARPGPQSPGSPLEEERQTQRSKPQPAVPPRPSADLILNRCSESTKRKLASAV

SEQ ID NO: 55610 - protein, 147 aa, Homo sapiens [sequence omitted]

SEQ ID NO: 55611 - protein, 252 aa, Homo sapiens
MGDTFIRHIALLGFEKRFVPSQHYVHVPGEMAGPVGEGGLPALHRDLRVPSPKWFDGQRAAENRQGTLTEYCGTLMSLPTKISRCPHLLDFFKVRPDDLKLPTDNQTKKPETYLMPKDGKSTATDITGPIILQTYRAIANYEKTSGSEMALSTGDVVEVVEKSESGQTSHLTGLLPLVLRNPQPQAPCQGSGSLAPGRTPALLGALNVLPTLWVAFCLSVHPVVAVGICAWQAGAGHVCVFCLDGYGTVCSL

SEQ ID NO: 55612 - protein, 526 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 55613 - protein, 526 aa, Homo sapiens; identical to SEQ ID NO: 55612

SEQ ID NO: 55614 - protein, 598 aa, Homo sapiens
GSPARGDAPTCLLSVSWQLSWPPSFYLIMSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVLYNIAFMYAKKEEWKKAEEQLALATSMKSEPRHSKIDKAMECVWKQKLYEPVVIPVGKLFRPNERQVAQLAKKDYLGKATVVASVVDQDSFSGFAPLQPQVRQSDLLGAQAGSVSSRQLQLDVELEPGWSQVPGSKFSVFAPWHHVRGWGLDLVSILCRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 55615 - protein, 481 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEKQKLYEPVVIPVGKLFRPNERQVAQLAKKDYLGKATVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 55616 - protein, 445 aa, Homo sapiens
MSLVEAISLWNEGVLAADKKDWKGALDAFSAVQDPHSRICFNIGCMYTILKNMTEAEKAFTRSINRDKHLAVAYFQRGMLYYQTEKYDLAIKDLKEALIQLRGNQLIDYKILGLQFKLFACEVVASVVDQDSFSGFAPLQPQAAEPPPRPKTPEIFRALEGEAHRVLFGFVPETKEELQVMPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVPLSEDSMKDAWGQVKNYCLTLWCENTVGDQGFPDEPKESEKADANNQTTEPQLKKGSQVEALFSYEATQPEDLEFQEGDIILVLSKVNEEWLEGECKGKVGIFPKVFVEDCATTDLESTRREV

SEQ ID NO: 55617 - protein, 143 aa, Homo sapiens
MPGNIVFVLKKGNDNWATVMFNGQKGLVPCNYLEPVELRIHPQQQPQEESSPQSDIPAPPSSKAPGRPQLSPGQKQKEEPKEVKLSVPMPYTLKVHYKYTVVMKTQPGLPYSQVRDMVSKKLELRLEHTKLSYRPRDSNELVP

SEQ ID NO: 55618 - protein, 56 aa, Homo sapiens
MPYTLKVHYKYTVVMKTQPGLPYSQVRDMVSKKLELRLEHTKLSYRPRDSNELVPL

SEQ ID NO: 55619 - protein, 339 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKDIAVEEDLSSTPLLKDLLELTRREFQREDIALNYRDAEGDLVRLLSDEDVALMVRQARGLPSQKRLFPWKLHITQKDNYRVYNTMP

SEQ ID NO: 55620 - protein, 348 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSLRPLPLTSPSHGSLSHSKAPSGSQMSHNAVTSHQRPGWPGQPHSPFPHPTPHFQPDASLLQPVTPLGTSRWRKISAALPY

SEQ ID NO: 55621 - protein, 166 aa, Homo sapiens
MRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSVAWEGGACPAFLPSL

SEQ ID NO: 55622 - protein, 159 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQKLARRDGAHL

SEQ ID NO: 55623 - protein, 611 aa, Homo sapiens
MNDISQKAEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 55624 - protein, 675 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIESKN

SEQ ID NO: 55625 - protein, 576 aa, Homo sapiens
  MOD_RES (1)..(1): Any amino acid
XVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIETDDY

SEQ ID NO: 55626 - protein, 321 aa, Homo sapiens
MNDISQKAEIKEMLASDDEEDVSSKVEKAYVPKLTGTVKGRFAEMEKQRQEEQRKRTEEERKRRIEQDMLEKRKIQRELAKRAEQIEDINNTGTESASEEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQK

SEQ ID NO: 55627 - protein, 435 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLK

SEQ ID NO: 55628 - protein, 662 aa, Homo sapiens
MNDISQKAEILLSSSKPVPKTYVPKLGKGDVKDKFEAMQRAREERNQRRSRDEKQRRKEQYIREREWNRRKQEIKEMLASDDEEDVSSKVEKAYVPKLTGTVKGRFAEMEKQRQEEQRKRTEEERKRRIEQDMLEKRKIQRELAKRAEQEGDDSLLITVVPVKSYKTSGKMKKNFEDLEKEREEKERIKYEEDKRIRYEEQRPSLKEAKCLSLVMDDEIESEAKKESLSPGKLKLTFEELERQRQENRKKQAEEEARKRLEEEKRAFEEARRQMVNEDEENQDTAKIFKGYRPGKLKLSFEEMERQRREDEKRKAEEEARRRIEEEKKAFAEARRNMVVDDDSPEMYKTISQEFLTPGKLEINFEELLKQKMEEEKRRTEEERKHKLEMEKQEFEQLRQEMGEEEEENETFGLSREYEELIKLKRSGSIQAKNLKSKFEKIGQLSEKEIQKKIEEERARRRAIDLEIKEREAENFHEEDDVDVRPARKSEAPFTHKVNMKARFEQMAKAREEEEQRRIEEQKLLRMQFEQREIDAALQKKREEEEEEEGSIMNGSTAEDEEQTRSGAPWFKKPLKNTSVVDSEPVRFTVKVTGEPKPEITWWFEGEILQDGEDYQYIERGETYCLYLPETFPEDGGEYMCKAVNNKGSAASTCILTIETDDY

SEQ ID NO: 55629 - protein, 270 aa, Homo sapiens
MENQPVRWRALPGLPRPPGLPAAPWLLLGVLLLPGTLRLAGGQSVTHTGLPIMASLANTAISFSCRITYPYTPQFKVFTVSYFHEDLQGQRSPKKPTNCHPGLGTENQSHTLDCQVTLVLPGASATGTYYCSVHWPHSTVRGSGTFILVRDAGYREPPQSPQKLLLFGFTGLLSVLSVVGTALLLWNKKRMRGPGKDPTRKCPDPRSASSPKQHPSESVYTALQRRETEVYACIENEDGSSPTAKQSPLSQERPHRFEDDGELNLVYENL

SEQ ID NO: 55630 - protein, 415 aa, Homo sapiens
MAPVSGSRSPDREASGSGGRRRSSSKSPKPSKSARSPRGRRSRSHSCSRSGDRNGLTHQLGGLSQGSRNQSYRSRSRSRSRERPSAPRGIPFASASSSVYYGSYSRPYGSDKPWPSLLDKEREESLRQKRLSERERIGELGAPEVWGLSPKNPEPDSDEHTPVEDEEPKKSTTSASTSEEEKKKKSSRSKERSKKRRKKKSSKRKHKKYSEDSDSDSDSETDSSDEDNKRRAKKAKKKEKKKKHRSKKYKKKRSKKSRKESSDSSSKESQEEFLENPWKDRTKAEEPSDLIGPEAPKTLTSQDDKPLNYGHALLPGEGAAMAEYVKAGKRIPRRGEIGLTSEEIASFECSGYVMSGSRHRRMEAVRLRKENQIYSADEKRALASFNQEERRKRENKILASFREMVYRKTKGKDDK

SEQ ID NO: 55631 - protein, 690 aa, Homo sapiens
MEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 55632 - protein, 690 aa, Homo sapiens; identical to SEQ ID NO: 55631

SEQ ID NO: 55633 - protein, 705 aa, Homo sapiens
MGFMLPLIFRYSPRLMEKILQMAEGIDIGEMPSYDLVLSKPSKGQKRHLSTCDGQNPPKKQAGSKFHARPRFEPVHFVASSSKDERQEDPYGPQTKEVNEQTHFASMPRDIYQDYTQDSFSIQDGNSQYCDSSGFILTKDQPVTANMYFDSGNPAPSTTSQQANSQSTPEPSPSQTFPESVVAEKQYFIEKLTATIWKNLSNPEMTSGSDKINYTYMLTRCIQACKTNPEYIYAPLKEIPPADIPKNKKLLTDGYACEVRCQNIYLTTGYAGSKNGSRDRATELAVKLLQKRIEVRVVRRKFKHTFGEDLVVCQIGMSSYEFPPALKPPEDLVVLGKDASGQPIFNASAKHWTNFVITENANDAIGILNNSASFNKMSIEYKYEMMPNRTWRCRVFLQDHCLAEGYGTKKTSKHAAADEALKILQKTQPTYPSVKSSQCHTGSSPRGSGKKKDIKDLVVYENSSNPVCTLNDTAQFNRMTVEYVYERMTGLRWKCKVILESEVIAEAVGVKKTVKYEAAGEAVKTLKKTQPTVINNLKKGAVEDVISRNEIQGRSAEEAYKQQIKEDNIGNQLLRKMGWTGGGLGKSGEGIREPISVKEQHKREGLGLDVERVNKIAKRDIEQIIRNYARSESHTDLTFSRELTNDERKQIHQIAQKYGLKSKSHGVGHDRYLVVGRKRRKEDLLDQLKQEGQVGHYELVMPQAN

SEQ ID NO: 55634 - protein, 189 aa, Homo sapiens
MLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKTESHSVIQAGVQWHDLDSLQAPPPGFTPFSCLSLLSSWDYRRPPPHPANFLYF

SEQ ID NO: 55635 - protein, 457 aa, Homo sapiens
MLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKGVARFYRSRKKHLITTQTEHKCVLDSCRSLEAEGFQVTYLPVQKSGIIDLKELEAAIQPDTSLVSVMTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 55636 - protein, 161 aa, Homo sapiens [sequence omitted]

SEQ ID NO: 55637 - protein, 255 aa, Homo sapiens
MTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 55638 - protein, 406 aa, Homo sapiens
MLLRAAWRRAAVAVTAAPGPKPAAPTRGLRLRVGDRAPQSAVPADTAAAPEVGPVLRPLYMDVQATTPLDPRVLDAMLPYLINYYGNPHSRTHAYGWESEAAMERARQQVASLIGADPREIIFTSGATESNNIAIKELEAAIQPDTSLVSVMTVNNEIGVKQPIAEIGRICSSRKVYFHTDAAQAVGKIPLDVNDMKIDLMSISGHKIYGPKGVGAIYIRRRPRVRVEALQSGGGQERGMRSGTVPTPLVVGLGAACEVAQQEMEYDHKRISKLSERLIQNIMKSLPDVVMNGDPKHHYPGCINLSFAYVEGESLLMALKDVALSSGSACTSASLEPSYVLRAIGTDEDLAHSSIRFGIGRFTTEEEVDYTVEKCIQHVKRLREMSPLWEMVQDGIDLKSIKWTQH

SEQ ID NO: 55639 - protein, 230 aa, Homo sapiens
MLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 55640 - protein, 113 aa, Homo sapiens
MDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 55641 - protein, 254 aa, Homo sapiens
MAATARRGWGAAAVAAGLRRRFCHMLKNPYTIKKQPLHQFVQRPLFPLPAAFYHPVRYMFIQTQDTPNPNSLKFIPGKPVLETRTMDFPTPAAAFRSPLARQLFRIEGVKSVFFGPDFITVTKENEELDWNLLKPDIYATIMDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQVMDDESDEKEANSP

SEQ ID NO: 55642 - protein, 99 aa, Homo sapiens
MDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEGVEQ

SEQ ID NO: 55643 - protein, 113 aa, Homo sapiens; identical to SEQ ID NO: 55640

SEQ ID NO: 55644 - protein, 96 aa, Homo sapiens
MDFFASGLPLVTEETPSGEAGSEEDDEVVAMIKELLDTRIRPTVQEDGGDVIYKGFEDGIVQLKLQGSCTSCPSSIITLKNGIQNMLQFYIPEVEG

SEQ ID NO: 55645 - protein, 487 aa, Homo sapiens
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEDGFPDFQDSVQTLFQQARAKSEELAALSSQQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 55646 - protein, 458 aa, Homo sapiens
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEDQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 55647 - protein, 487 aa, Homo sapiens; identical to SEQ ID NO: 55645

SEQ ID NO: 55648 - protein, 486 aa, Homo sapiens
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGESRLWQGHHATESEHSLSPADLGSPASPKESSEALDAAAALSVAECVERMAPTLPKSDLNEVKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEDGFPDFQDSVQTLFQQARAKSEELAALSSQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 55649 - protein, 157 aa, Homo sapiens
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLALQSVGE

SEQ ID NO: 55650 - protein, 62 aa, Homo sapiens
MAAALPRTLGELQLYRILQKANLLSYFDAFIQQGGDDVQQLCEAGEEEFLEIMALVGMASKP

SEQ ID NO: 55651 - protein, 100 aa, Homo sapiens
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLP

SEQ ID NO: 55652 - protein, 240 aa, Homo sapiens
  MOD_RES (1)..(1): Any amino acid
XKELLKTNKKLAKMIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 55653 - protein, 152 aa, Homo sapiens
MAAALPRTLGELQLYRILQKANLLSYFDAFIQQGGDDVQQLCEAGEEEFLEIMALVGMASKPLHVRRLQKALRDWVTNPGLFNQPLTSLPVSSIPIYKLPEGSPTWLGISCSSYERSSNAREPHLKIPKCAATTCVQSLGQGKSDVVGSLAL

SEQ ID NO: 55654 - protein, 227 aa, Homo sapiens
MIGHIFEMNDDDPHKEEEIRKYSAIYGRFDSKRKDGKHLTLHELTVNEAAAQLCVKDNALLTRRDELFALARQISREVTYKYTYRTTKSKCGERDELSPKRIKVEQPEKVMAKQMEFLCNQAGYERLQHAERRLSAGLYRQSSEEHSPNGLTSDNSDGQGERPLNLRMPNLQNRQPHHFVVDGELSRLYPSEAKSHSSESLGILKDYPHSAFTLEKKVIKTEPEDSR

SEQ ID NO: 55655 - protein, 525 aa, Homo sapiens
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQAVGSCPRLTPPPADLPLALPAHGLWSRHILQQTLMDEGLRLARLVSHDRVGRLSPCVPAKPPLAEFEEGLLDRCPAPGPHPALVEGRRSSVKVEAEASRQ

SEQ ID NO: 55656 - protein, 461 aa, Homo sapiens
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHELTINEAAAQFCMRDNTLLLRRVELFSLSRQVARESTYLSSLKGSRLHPEELGGPPLKKLKQEVGEQSHPEIQQPPPGPESYVPPYRPSLEEDSASLSGESLDGHLQEFEEGLLDRCPAPGPHPALVEGRRSSVKVEAEASRQ

SEQ ID NO: 55657 - protein, 322 aa, Homo sapiens
MHRAPSPTAEQPPGGGDSARRTLQPRLKPSARAMALPRTLGELQLYRVLQRANLLSYYETFIQQGGDDVQQLCEAGEEEFLEIMALVGMATKPLHVRRLQKALREWATNPGLFSQPVPAVPVSSIPLFKISETAGTRKGSMSNGHGSPGEKAGSARSFSPKSPLELGEKLSPLPGGPGAGDPRIWPGRSTPESDVGAGGEEEAGSPPFSPPAGGGVPEGTGAGGLAAGGTGGGPDRLEPEMVRMVVESVERIFRSFPRGDAGEVTSLLKLNKKLARSVGHIFEMDDNDSQKEEEIRKYSIIYGRFDSKRREGKQLSLHEASP

SEQ ID NO: 55658 - protein, 240 aa, Homo sapiens
  MOD_RES (1)..(1): Any amino acid
XSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKDIITLRNFWKQDVDGVASGPIVLHCAAEL

SEQ ID NO: 55659 - protein, 654 aa, Homo sapiens [sequence omitted]

SEQ ID NO: 55660 - protein, 633 aa, Homo sapiens
AALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 55661 - protein, 558 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMITVFTPMLIFLVPLKLFWKQN

SEQ ID NO: 55662 - protein, 612 aa, Homo sapiens
MRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTDHVWTEVYSPSQQRWLHCDACEDVCDKPLLYEIGWGKKLSYVIAFSKDEVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 55663 - protein, 171 aa, Homo sapiens
MGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKDIITLRNFWKQDVDGVASGPIVLHCAAEL

SEQ ID NO: 55664 - protein, 636 aa, Homo sapiens
MAAAALGSSSGSASPAVAELCQNTPETFLEASKLLLTYADNILRNPNDEKYRSIRIGNTAFSTRLLPVRGAVECLFEMGFEEGETHLIFPKKASVEQLQKIRDLIAIERSSRLDGSNKSHKVKSSQQPAASTQLPTTPSSNPSGLNQHTRNRQGQSSDPPSASTVAADSAILEVLQSNIQHVLVYENPALQEKALACIPVQELKRKSQEKLSRARKLDKGINISDEDFLLLELLHWFKEEFFHWVNNVLCSKCGGQTRSRDRSLLPSDDELKWGAKEVEDHYCDACQFSNRFPRYNNPEKLLETRCGRCGEWANCFTLCCRAVGFEARYVWDYTELQRTLSLKLTTLKEIGKTFLRISKRQKLIQVVDVTWRYSCKHEEVIARRTKVKEALLRDTINGLNKQRQLFLSENRRKELLQRIIVELVEFISPKTPKPGELGGRISGSVAWRVARGEMGLQRKETLFIPCENEKISKQLHLCYNIVKDRYVRVSNNNQTISGWENGVWKMESIFRKVETDWHMVYLARKEGSSFAYISWKFECGSVGLKVDSISIRTSSQTFQTGTVEWKLRSDTAQVELTGDNSLHSYADFSGATEVILEAELSRGDGDVAWQHTQLFRQSLNDHEENCLEIIIKFSDL

SEQ ID NO: 55665 - protein, 395 aa, Homo sapiens
MAAEASESGPALHELMREAEISLLECKVCFEKFGHRQQRRPRNLSCGHVVCLACVAALAHPRTLALECPFCRRACRGCDTSDCLPVLHLIELLGSALRQSPAAHRAAPSAPGALTCHHTFGGWGTLVNPTGLALCPKTGRVVVVHDGRRRVKIFDSGGGCAHQFGEKGDAAQDIRYPVDVTITNDCHVVVTDAGDRSIKVFDFFGQIKLVIGGQFSLPWGVETTPQNGIVVTDAEAGSLHLLDVDFAEGVLRRTERLQAHLCNPRGVAVSWLTGAIAVLEHPLALGTGVCSTRVKVFSSSMQLVGQVDTFGLSLYFPSKITASAVTFDHQGNVIVADTSGPAILCLGKPEEFPVPKPMVTHGLSHPVALTFTKENSLLVLDTASHSIKVYKVDWG

SEQ ID NO: 55666 - protein, 128 aa, Homo sapiens
MTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLKQQIQSIQQSIERLLV

SEQ ID NO: 55667 - protein, 128 aa, Homo sapiens; identical to SEQ ID NO: 55666

SEQ ID NO: 55668 - protein, 128 aa, Homo sapiens; identical to SEQ ID NO: 55666

SEQ ID NO: 55669 - protein, 132 aa, Homo sapiens
MLLVQTEADVNPKAYPLADAHLTKKLLDLVQQSCNYKQLRKGANEATKTLNRGISEFIVMAADAEPLEIILHLPLLCEDKNVPYVFVRSKQALGRACGVSRPVIACSVTIKEGSQLKQQIQSIQQSIERLLV

SEQ ID NO: 55670 - protein, 709 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 55671 - protein, 689 aa, Homo sapiens
MDFNLILESLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 55672 - protein, 451 aa, Homo sapiens [sequence omitted]

SEQ ID NO: 55673 - protein, 305 aa, Homo sapiens
MLKPINTTGTLKPDDRVVVAATRLDSRSFFWNVAPGAESAVASFVTQLAAAEALQKAPDVTTLPRNVMFVFFQGVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKD

SEQ ID NO: 55674 - protein, 689 aa, Homo sapiens; identical to SEQ ID NO: 55671

SEQ ID NO: 55675 - protein, 255 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQETFDYIGSSRMVYDMEKGKFPVQLENVDSFVELGQVALRTSLELWMHTDPVSQKNESVRNQ

SEQ ID NO: 55676 - protein, 320 aa, Homo sapiens
  MOD_RES (1)..(1): Any amino acid
XGFGVYSNSYGPEFAHCREIQWNSLGNGLAYEDFSFPIFLLEDENETKVIKQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTA

SEQ ID NO: 55677 - protein, 219 aa, Homo sapiens
RSSIQSTFSINPEIVCDPLSDYNVWSMLKPINTTGTLKPDDRVVVAATRLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEE

SEQ ID NO: 55678 - protein, 275 aa, Homo sapiens
  MOD_RES (1)..(1): Any amino acid
XNVAPGAESAVASFVTQLAAAEALQKAPDVTTLPRNVMFVFFQGVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKD

SEQ ID NO: 55679 - protein, 134 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRQNVRLSDTFLCSFMEFLSYSRDLMEKLKG

SEQ ID NO: 55680 - protein, 232 aa, Homo sapiens
MATAGGGSGADPGSRGLLRLLSFCVLLAGLFLDFEPDPLPLCPDVSFFPQPQPPTPQSKGTGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDH

SEQ ID NO: 55681 - protein, 571 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 55682 - protein, 213 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQMLCDMARISELRLILRQPSPLWLSFTVEELQIYQQGPKSPSVTFPKWLSHPVPCEQPALLREGLPDPSRVSSEVQQMWALTEMIRASHTSARIGRFDVDGCYDLNLLSYT

SEQ ID NO: 55683 - protein, 213 aa, Homo sapiens; identical to SEQ ID NO: 55682

SEQ ID NO: 55684 - protein, 175 aa, Homo sapiens
MSRVLVPCHVKGSVALQVGDVRTSQGRPGVLVIDVTFPSVAPFELQEITFKNYYTAFLSIRVRQYTSAHTPAKWVTCLRDYCLMPDPHSEEGAQEYVSLFKHQSPSVTFPKWLSHPVPCEQPALLREGLPDPSRVSSEVQQMWALTEMIRASHTSARIGRFDVDGCYDLNLLSYT

SEQ ID NO: 55685 - protein, 264 aa, Homo sapiens
MESGFTSKDTYLSHFNPRDYLEKYYKFGSRHSAESQILKHLLKNLFKIFCLDGVKGDLLIDIGSGPTIYQLLSACESFKEIVVTDYSDQNLQELEKWLKKEPEAFDWSPVVTYVCDLEGNRVKGPEKEEKLRQAVKQVLKCDVTQSQPLGAVPLPPADCVLSTLCLDAACPDLPTYCRALRNLGSLLKPGGFLVIMDALKSSYYMIGEQKFSSLPLGREAVEAAVKEAGYTIEWFEVISQSYSSTMANNEGLFSLVARKLSRPL

SEQ ID NO: 55686 - protein, 264 aa, Homo sapiens; identical to SEQ ID NO: 55685

SEQ ID NO: 55687 - protein, 252 aa, Homo sapiens
MKSRIPVVLLACGSFNPITNMHLRMFEVARDHLHQTGMYQVIQGIISPVNDTYGKKDLAASHHRVAMARLALQTSDWIRVDPWESEQAQWMETVKVLRHHHSKLLRSPPQMEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 55688 - protein, 215 aa, Homo sapiens
MYQVIQGIISPVNDTYGKKDLAASHHRVAMARLALQTSDWIRVDPWESEQAQWMETVKVLRHHHSKLLRSPPQMEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 55689 - protein, 215 aa, Homo sapiens; identical to SEQ ID NO: 55688

SEQ ID NO: 55690 - protein, 142 aa, Homo sapiens
MEGPDHGKALFSTPAAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 55691 - protein, 114 aa, Homo sapiens
MKSRIPVVLLACGSFNPITNMHLRMFEVARDHLHQTGMYQVIQGIISPVNDTYGKKDLAASHHRVAMARLALQTSDWIRVDPWESEQAQWMETVKVLRHHHSKLLRSPPQMEGP

SEQ ID NO: 55692 - protein, 163 aa, Homo sapiens
MKSRIPVVLLACGSFNPITNMHLRMFEVARDHLHQTAVPELKLLCGADVLKTFQTPNLWKDAHIQEIVEKFGLVCVGRVGHDPKGYIAESPILRMHQHNIHLAKEPVQNEISATYIRRALGQGQSVKYLIPDAVITYIKDHGLYTKGSTWKGKSTQSTEGKTS

SEQ ID NO: 55693 - protein, 1086 aa, Homo sapiens
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTGQITAAGKVPPAKILIVGGGVAGLASAGAAKSMGAIVRGFDTRAAALEQFKSLGAEPLEVDLKESGEGQGGYAKEMSKEFIEAEMKLFAQQCKEVDILISTALIPGKKAPVLFNKEMIESMKEGSVVVDLAAEAGGNFETTKPGELYIHKGITHIGYTDLPSRMATQASTLYSNNITKLLKAISPDKDNFYFDVKDDFDFGTMGHVIRGTVVMKDGKVIFPAPTPKNIPQGAPVKQKTVAELEAEKAATITPFRKTMSTASAYTAGLTGILGLGIAAPNLAFSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 55694 - protein, 1086 aa, Homo sapiens; identical to SEQ ID NO: 55693

SEQ ID NO: 55695 - protein, 199 aa, Homo sapiens
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIA

SEQ ID NO: 55696 - protein, 217 aa, Homo sapiens
MANLLKTVVTGCSCPLLSNLGSCKGLRVKKDFLRTFYTHQELWCKAPVKPGIPYKQLTVGVPKEIFQNEKRVALSPAGVQNLVKQGFNVVVESGAGEASKFSDDHYRVAGAQIQGAKEVLASDLVVKVRAPMVNPTLGVHEADLLKTSGTLISFIYPAQNPELLNKLSQRKTTVLAMDQVPRVTIAQGYDALSSMANIAGYKAVVLAANHFGRFFTG

SEQ ID NO: 55697 - protein, 601 aa, Homo sapiens
MLSWNRVRAKLPSSQMVTTFGLAGIVGYHTVWGVTPALHSPLMSVTNAISGLTAVGGLALMGGHLYPSTTSQGLAALAAFISSVNIAGGFLVTQRMLDMFKRPTDPPEYNYLYLLPAGTFVGGYLAALYSGYNIEQIMYLGSGLCCVGALAGLSTQGTARLGNALGMIGVAGGLAATLGVLKPGPELLAQMSGAMALGGTIGLTIAKRIQISDLPQLVAAFHSLVGLAAVLTCIAEYIIEYPHFATDAAANLTKIVAYLGTYIGGVTFSGSLIAYGKLQGLLKSAPLLLPGRHLLNAGLLAASVGGIIPFMVDPSFTTGITCLGSVSALSAVMGVTLTAAIGGADMPVVITVLNSYSGWALCAEGFLLNNNLLTIVGALIGSSGAILSYIMCVAMNRSLANVILGGYGTTSTAGGKPMEISGTHTEINLDNAIDMIREANSIIITPGYGLCAAKAQYPIADLVKMLTEQGKKVRFGIHPVAGRMPGQLNVLLAEAGVPYDIVLEMDEINHDFPDTDLVLVIGANDTVNSAAQEDPNSIIAGMPVLEVWKSKQVIVMKRSLGVGYAAVDNPIFYKPNTAMLLGDAKKTCDALQAKVRESYQK

SEQ ID NO: 55698 - protein, 491 aa, Homo sapiens [sequence omitted]

SEQ ID NO: 55699 - protein, 368 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYKEHFQDDVFNEKGWNYILEKYDGHLPIEIKAVPEGFVIPRGNVLFTVENTDPECYWLTNWIETILVQSWYPITVATNSREQKKILAKYLLETSGNLDGLEYKLHDFGYRGVSSQETAGIGASAHLVNFKGTDTVAGLALIKKYYGTKDPVPGYSVPAAEHSTITAWGKDHEKDAFEHIVTQFSSVPVSVVSDSYDIYNACEKIWGEDLRHLIVSRSTQAPLIIRPDSGNPLDTVLKVLEILGKKFPVTENSKGYKLLPPYLRVIQGDGVDINTLQEVCVLY

SEQ ID NO: 55700 - protein, 60 aa, Homo sapiens
MNPAAEAEFNILLATDSYKVTHYKQYPPNTSKVYSYFECREKKTENSKLRKVKYEETVFY

SEQ ID NO: 55701 - protein, 88 aa, Homo sapiens
MNPAAEAEFNILLATDSYKVTHYKQYPPNTSKVYSYFECREKKTENSKLRKVKYEETVFYGLQYILNKYLKGKVVTKEKIQEAKDVYK

SEQ ID NO: 55702 - protein, 566 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQLCEPLPSLAESRALAQLSLSRLSPEHRRLRSPAQYQVGGGPPCHSALCAPALTLPTAPVLCSLQVVLSERLQALVNSLCAGQSP

SEQ ID NO: 55703 - protein, 525 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQLCEPLPSLAESRALAQLSLSRLSPEHRRLRSPAQYQVVLSERLQALVNSLCAGQSP

SEQ ID NO: 55704 - protein, 490 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQVAAPPPSS

SEQ ID NO: 55705 - protein, 538 aa, Homo sapiens
MAAEQDPEARAAARPLLTDLYQATMALGYWRAGRARDAAEFELFFRRCPFGGAFALAAGLRDCVRFLRAFRLRDADVQFLASVLPPDTDPAFFEHLRALDCSEVTVRALPEGSLAFPGVPLLQVSGPLLVVQLLETPLLCLVSYASLVATNAARLRLIAGPEKRLLEMGLRRAQGPDGGLTASTYSYLGGFDSSSNVLAGQLRGVPVAGTLAHSFVTSFSGSEVPPDPMLAPAAGEGPGVDLAAKAQVWLEQVCAHLGLGVQEPHPGERAAFVAYALAFPRAFQGLLDTYSVWRSGLPNFLAVALALGELGYRAVGVRLDSGDLLQQAQEIRKVFRAAAAQFQVPWLESVLIVVSNNIDEEALARLAQEGSEVNVIGIGTSVVTCPQQPSLGGVYKLVAVGGQPRMKLTEDPEKQTLPGSKAAFRLLGSDGSPLMDMLQLAEEPVPQAGQELRVWPPGAQEPCTVRPAQVEPLLRLCLQQGQLCEPLPSLAESRALAQLSLSRLSPEHRRLRSPAQYQVVLSERLQALVNSLCAGQSP

SEQ ID NO: 55706 - protein, 1375 aa, Homo sapiens
MEGDRVAGRPVLSSLPVLLLLPLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 55707 - protein, 969 aa, Homo sapiens
MEGDRVAGRPVLSSLPVLLLLPLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 55708 - protein, 1180 aa, Homo sapiens
TPQTERITHSSISWSFLLRFSRGKLLMLRAAALHPDELFPHGESWGDQLLQEGDDESSAVVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCILITPPANPCEDGSHTCAPAGQARCVHHGGSTFSCACLPGYAGDGHQCTDVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHVKWISPVGGRAAWLSQWEPPHRPCCSEVDWCREVLEGF

SEQ ID NO: 55709 - protein, 1274 aa, Homo sapiens
MEGDRVKLANPLHFYEARFSNLYVGTNGIISTQDFPRETQYVDYDFPTDFPAIAPFLADIDTSHGRGRVLYREDTSPAVLGLAARYVRAGFPRSARFTPTHAFLATWEQVGAYEEVKRGALPSGELNTFQAVLASDGSDSYALFLYPANGLQFLGTRPKESYNVQLQLPARVGFCRGEADDLKSEGPYFSLTSTEQSVKNLYQLSNLGIPGVWAFHIGSTSPLDNVRPAAVGDLSAAHSSVPLGRSFSHATALESDYNEDNLDYYDVNEEEAEYLPGEPEEALNGHSSIDVSFQSKVDTKPLEESSTLDPHTKEGTSLGEVGGPDLKGQVEPWDERETRSPAPPEVDRDSLAPSWETPPPYPENGSIQPYPDGGPVPSEMDVPPAHPEEEIVLRSYPASGHTTPLSRGTYEVGLEDNIGSNTEVFTYNAANKETCEHNHRQCSRHAFCTDYATGFCCHCQSKFYGNGKHCLPEGAPHRVNGKVSGHLHVGHTPVHFTDVDLHAYIVGNDGRAYTAISHIPQPAAQALLPLTPIGGLFGWLFALEKPGSENGFSLAGAAFTHDMEVTFYPGEETVRITQTAEGLDPENYLSIKTNIQGQVPYVSANFTAHISPYKELYHYSDSTVTSTSSRDYSLTFGAINQTWSYRIHQNITYQVCRHAPRHPSFPTTQQLNVDRVFALYNDEERVLRFAVTNQIGPVKEDSDPTPGNPCYDGSHMCDTTARCHPGTGVDYTCECASGYQGDGRNCVDENECATGFHRCGPNSVCINLPGSYRCECRSGYEFADDRHTCIYVDECSENRCHPAATCYNTPGSFSCRCQPGYYGDGFQCIPDSTSSLTPCEQQQRHAQAQYAYPGARFHIPQCDEQGNFLPLQCHGSTGFCWCVDPDGHEVPGTQTPPGSTPPHCGPSPEPTQRPPTICERWRENLLEHYGGTPRDDQYVPQCDDLGHFIPLQCHGKSDFCWCVDKDGREVQGTRSQPGTTPACIPTVAPPMVRPTPRPDVTPPSVGTFLLYTQGQQIGYLPLNGTRLQKDAAKTLLSLHGSIIVGIDYDCRERMVYWTDVAGRTISRAGLELGAEPETIVNSGLISPEGLAIDHIRRTMYWTDSVLDKIESALLDGSERKVLFYTDLVNPRAIAVDPIRGNLYWTDWNREAPKIETSSLDGENRRILINTDIGLPNGLTFDPFSKLLCWADAGTKKLECTLPDGTGRRVIQNNLKYPFSIVSYADHFYHTDWRRDGVVSVNKHSGQFTDEYLPEQRSHLYGITAVYPYCPTGRK

SEQ ID NO: 55710 - protein, 1278 aa, Homo sapiens
MTARGLALGLLLLLLCPAQVFSQSCVWYGECGIAYGDKRYNCEYSGPPKPLPKDGYDLVQELCPGFFFGNVSLCCDVRQLQTLKDNLQLPLQFLSRCPSCFYNLLNLFCELTCSPRQSQFLNVTATEDYVDPVTNQTKTNVKELQYYVGQSFANAMYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 55711 - protein, 960 aa, Homo sapiens
MYVIMWITYMAFLLVFFGAFFAVWCYRKRYFVSEYTPIDSNIAFSVNASDKGTAWLLTSTFPSSPVLPGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDNYTRIGFAPSSWIDDYFDWVKPQSSCCRVDNITDQFCNASVVDPACVRCRPLTPEGKQRPQGGDFMRFLPMFLSDNPNPKCGKGGHAAYSSAVNILLGHGTRVGATYFMTYHTVLQTSADFIDALKKARLIASNVTETMGINGSAYRVFPYSVFYVFYEQYLTIIDDTIFNLGVSLGAIFLVTMVLLGCELWSAVIMCATIAMVLVNMFGVMWLWGISLNAVSLVNLVMSCGISVEFCSHITRAFTVSMKGSRVERAEEALAHMGSSVFSGITLTKFGGIVVLAFAKSQIFQIFYFRMYLAMVLLGATHGLIFLPVLLSYIGPSVNKAKSCATEERYKGTERERLLNF

SEQ ID NO: 55712 - protein, 776 aa, Homo sapiens
MYNACRDVEAPSSNDKALGLLCGKDADACNATNWIEYMFNKDNGQAPFTITPVFSDFPVHGMEPMNNATKGCDESVDEVTAPCSCQDCSIVCGPKPQPPPPPAPWTILGLDAMYVIMWITYMAFLLVFFGAFFAVWCYRKRYFVSEYTPIDSNIAFSVNASDKGEASCCDPVSAAFEGCLRRLFTRWGSFCVRNPGCVIFFSLVFITACSSGLVFVRVTTNPVDLWSAPSSQARLEKEYFDQHFGPFFRTEQLIIRAPLTDKHIYQPYPSGADVPFGPPLDIQILHQVLDLQIAIENITASYDNETVTLQDICLAPLSPYNTNCTILSVLNYFQNSHSVLDHKKGDDFFVYADYHTHFLYCVRAPASLNDTSLLHDPCLGTFGGPVFPWLVLGGYDDQNYNNATALVITFPVNNYYNDTEKLQRAQAWEKEFINFVKNYKNPNLTISFTAERSIEDELNRESDSDVFTVVISYAIMFLYISLALGHMKSCRRLLVDSKVSLGIAGILIVLSSVACSLGVFSYIGLPLTLIVIEVIPFLVLAVGVDNIFILVQAYQRDERLQGETLDQQLGRVLGEVAPSMFLSSFSETVAFFLGALSVMPAVHTFSLFAGLAVFIDFLLQITCFVSLLGLDIKRQEKNRLDIFCCVRGAEDGTSVQASESCLFRFFKNSYSPLLLKDWMRPIVIAIFVGVLSFSIAVLNKVDIGLDQSLSMPDDSYMVDYFKSISQYLHAGPPVYFVLEEGHDYTSSKGQNMVCGGMGCNNDSLVQQIFNAAQLDN

SEQ ID NO: 55713 - protein, 122 aa, Homo sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSV

SEQ ID NO: 55714 - protein, 151 aa, Homo sapiens
MRFLAATFLLLALSTAAQAEPVQFKDCGSVDGVIKEVNVSPCPTQPCQLSKGQSYSVNVTFTSNIQSKSSKAVVHGILMGVPVPFPIPEPDGCKSGINCPIQKDKTYSYLNKLPVKSEYPSIKLVVEWQLQDDKNQSLFCWEIPVQIVSHL

SEQ ID NO: 55715 - protein, 350 aa, Homo sapiens
MDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 55716 - protein, 252 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKHQDNTFYKSAGCQLKFVT

SEQ ID NO: 55717 - protein, 377 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKPLLLHTGMGRLCTLDESVSLATMIDRIKRHLKLSHIRLALGVGRTLESQVKVVALCAGSGSSVLQGVEADLYLTGEMSHHDTLDAASQGINVILCEHSNTERGFLSDLRDMLDSHLENKINIILSETDRDPLQVV

SEQ ID NO: 55718 - protein, 162 aa, Homo sapiens
MDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGI

SEQ ID NO: 55719 - protein, 377 aa, Homo sapiens; identical to SEQ ID NO: 55717

SEQ ID NO: 55720 - protein, 285 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTEILSLEKSLKSKSWPCVLVLGAAFCRVLRLTFTSQVRCPIMILWMLLPKE

SEQ ID NO: 55721 - protein, 377 aa, Homo sapiens; identical to SEQ ID NO: 55717

SEQ ID NO: 55722 - protein, 209 aa, Homo sapiens
MDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPTEGNHRVEFNVNYTQDLDKVMSAVKGIDGVSVTSFSARTGNEEQTRINLNCTQKALMQVVDFLSRNKQLYQKTE

SEQ ID NO: 55723 - protein, 163 aa, Homo sapiens
MLSSCVRPVPTTVRFVDSLICNSSRSFMDLKALLSSLNDFASLSFAESWDNVGLLVEPSPPHTVNTLFLTNDLTEEVMEEVLQKKADLILSYHPPIFRPMKRITWNTWKERLVIRALENRVGIYSPHTAYDAAPQGVNNWLAKGLGACTSRPIHPSKAPNYPT

SEQ ID NO: 55724 - protein, 1582 aa, Homo sapiens
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKGIPLIFEREEAIKEQYTVRRFRGPSCTHELLRLPTSSRCRPLRVLHGEPSQPRWLPDREEPQVQALQQLQGAARVFMPLQALDSAPKPLKGQAQAPQRLQGAARVFMPLQAQVKAKASKPLQMQIKAPPRLRRAARVLMPLQAQVRAPRLLQVQSQVSKKQQAQTQTSEPQDLDQVPEEFQGQDQVPEQQRQGQAPEQQQRHNQVPEQELEQNQAPEQPEVQEQAAEPAQAETEAEEPESLRVNAQVFLPLLSQDHHVLLPLHLDTQVLIPVEGQTEGSPQAQAWTLEPPQAIGSVQALIEGLSRDLLRAPNSNNSKPLGPLQTLMENLSSNRFYSQPEQAREKKSKVSTLRQALAKRLSPKRFRAKSSWRPEKLELSDLEARRQRRQRRWEDIFNQHEEELRQVDKDKEDESSDNDEVFHSIQAEVQIEPLKPYISNPKKIEVQERSPSVPNNQDHAHHVKFSSSVPQRSLLEQAQKPIDIRQRSSQNRQNWLAASESSSEEESPVTGRRSQSSPPYSTIDQKLLVDIHVPDGFKVGKISPPVYLTNEWVGYNALSEIFRNDWLTPAPVIQPPEEDGDYVELYDASADTDGDDDDESNDTFEDTYDHANGNDDLDNQVDQANDVCKDHDDDNNKFVDDVNNNYYEAPSCPRASYGRDGSCKQDGYDGSRGKEEAYRGYGSHTANRSHGGSAASEDNAAIGDQEEHAANIGSERRGSEGDGGKGVVRTSEESGALGLNGEENCSETDGPGLKRPASQDFEYLQEEPGGGNEASNAIDSGAAPSAPDHESDNKDISESSTQSDFSANHSSPSKGSGMSADANFASAILYAGFVEVPEESPKQPSEVNVNPLYVSPACKKPLIHMYEKEFTSEICCGSLWGVNLLLGTRSNLYLMDRSGKADITKLIRRRPFRQIQVLEPLNLLITISGHKNRLRVYHLTWLRNKILNNDPESKRRQEEMLKTEEACKAIDKLTGCEHFSVLQHEETTYIAIALKSSIHLYAWAPKSFDESTAIKVCIDQSADSEGDYMSYQAYIRILAKIQAADPVNRFKRPDELLHLLKLKVFPTLDHKPVTVDLAIGSEKRLKIFFSSADGYHLIDAESEVMSDVTLPKNPLEIIIPQNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 55725 - protein, 1583 aa, Homo sapiens
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQGLAHLHAHRVIHRDIKGQNVLLTHNAEVKLVDFGVSAQVSRTNGRRNSFIGTPYWMAPEVIDCDEDPRRSYDYRSDVWSVGITAIEMAEGAPPLCNLQPLEALFVILRESAPTVKSSGWSRKFHNFMEKCTIKNFLFRPTSANMLQHPFVRDIKNERHVVESLTRHLTGIIKKRQKKKGIPLIFEREEAIKEQYTVRRFRGPSCTHELLRLPTSSRCRPLRVLHGEPSQPRWLPDREEPQVQALQQLQGAARVFMPLQALDSAPKPLKGQAQAPQRLQGAARVFMPLQAQVKAKASKPLQMQIKAPPRLRRAARVLMPLQAQVRAPRLLQVQSQVSKKQQAQTQTSEPQDLDQVPEEFQGQDQVPEQQRQGQAPEQQQRHNQVPEQELEQNQAPEQPEVQEQAAEPAQAETEAEEPESLRVNAQVFLPLLSQDHHVLLPLHLDTQVLIPVEGQTEGSPQAQAWTLEPPQAIGSVQALIEGLSRDLLRAPNSNNSKPLGPLQTLMENLSSNRFYSQPEQAREKKSKVSTLRQALAKRLSPKRFRAKSSWRPEKLELSDLEARRQRRQRRWEDIFNQHEEELRQVDKDKEDESSDNDEVFHSIQAEVQIEPLKPYISNPKKIEVQERSPSVPNNQDHAHHVKFSSSVPQRSLLEQAQKPIDIRQRSSQNRQNWLAASESSSEEESPVTGRRSQSSPPYSTIDQKLLVDIHVPDGFKVGKISPPVYLTNEWVGYNALSEIFRNDWLTPAPVIQPPEEDGDYVELYDASADTDGDDDDESNDTFEDTYDHANGNDDLDNQVDQANDVCKDHDDDNNKFVDDVNNNYYEAPSCPRASYGRDGSCKQDGYDGSRGKEEAYRGYGSHTANRSHGGSAASEDNAAIGDQEEHAANIGSERRGSEGDGGKGVVRTSEESGALGLNGEENCSETDGPGLKRPASQDFEYLQEEPGGGNEASNAIDSGAAPSAPDHESDNKDISESSTQSDFSANHSSPSKGSGMSADANFASAILYAGFVEVPEESPKQPSEVNVNPLYVSPACKKPLIHMYEKEFTSEICCGSLWGVNLLLGTRSNLYLMDRSGKADITKLIRRRPFRQIQVLEPLNLLITISGHKNRLRVYHLTWLRNKILNNDPESKRRQEEMLKTEEACKAIDKLTGCEHFSVLQHEETTYIAIALKSSIHLYAWAPKSFDESTAIKVCIDQSADSEGDYMSYQAYIRILAKIQAADPVNRFKRPDELLHLLKLKVFPTLDHKPVTVDLAIGSEKRLKIFFSSADGYHLIDAESEVMSDVTLPKNPLEIIIPQNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 55726 - protein, 188 aa, Homo sapiens
MAGPGGWRDREVTDLGHLPDPTGIFSLDKTIGLGTYGRIYLGLHEKTGAFTAVKVMNARKTPLPEIGRRVRVNKYQKSVGWRYSDEEEDLRTELNLLRKYSFHKNIVSFYGAFFKLSPPGQRHQLWMVMELCAAGSVTDVVRMTSNQSLKEDWIAYICREILQPKVIFLGTGCSDSSLKKELCLKHQN

SEQ ID NO: 55727 - protein, 163 aa, Homo sapiens
MQVPRERIKIAFRLWIPILVIRIVVAGTWPQAPGLSTLGLNIIILPDCLGIGMMLTFNAEALSVEANEQLFKKILEMWKDIPSSIAFECTQRTTGWGQKAIEVRSLQSRVLESELKRRSIKKLRFLCTRGDKLFFTSTLRNHHSRVYFMTLGKLEELQSNYDV

SEQ ID NO: 55728 - protein, 482 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHGDCNLISLDEYWKNEK

SEQ ID NO: 55729 - protein, 645 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHEIPEDPLVAEEYYADAFDSYCEESDEEEEEIALERPEKEIRNEGSQPAYRTNQQDSDIEALARCLENVLGCTSLDTKTITTMAEDMSPGPPIFNSVMARTKMKRMRESAMQKLGTEVFEEVYNYLKRARHQNASEAEIRECLEKVVPQASDCFEVDQLLYFEEQLLITMGKEPTLQNHL

SEQ ID NO: 55730 - protein, 461 aa, Homo sapiens
MHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHESDEPTLENLPESQPIPSMDLHELESIVEDATSDLGYHEIPEDPLVAEEYYADAFDSYCEESDEEEEEIALERPEKEIRNEGSQPAYRTNQQDSDIEALARCLENVLGCTSLDTKTITTMAEDMSPGPPIFNSVMARTKMKRMRESAMQKLGTEVFEEVYNYLKRARHQNASEAEIRECLEKVVPQASDCFEVDQLLYFEEQLLITMGKEPTLQNHL

SEQ ID NO: 55731 - protein, 645 aa, Homo sapiens; identical to SEQ ID NO: 55729

SEQ ID NO: 55732 - protein, 482 aa, Homo sapiens; identical to SEQ ID NO: 55728

SEQ ID NO: 55733 - protein, 645 aa, Homo sapiens; identical to SEQ ID NO: 55729

SEQ ID NO: 55734 - protein, 470 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHATHS

SEQ ID NO: 55735 - protein, 692 aa, Homo sapiens
MEKYERIRVVGRGAFGIVHLCLRKADQKLVIIKQIPVEQMTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFEAANLPALVLKIMSGTFAPISDRYSPELRQLVLSLLSLEPAQRPPLSHIMAQPLCIRALLNLHTDVGSVRMRRAEKSVAPSNTGSRTTSVRCRGIPRGPVRPAIPPPLSSVYAWGGGLGTPLRLPMLNTEVVQVAAGRTQKAGVTRSGRLILWEAPPLGAGGGSLLPGAVEQPQPQFISRFLEGQSGVTIKHVACGDFFTACLTDRGIIMTFGSGSNGCLGHGSLTDISQPTIVEALLGYEMVQVACGASHVLALSTERELFAWGRGDSGRLGLGTRESHSCPQQVPMPPGQEAQRVVCGIDSSMILTVPGQALACGSNRFNKLGLDHLSLGEEPVPHQQVEEALSFTLLGSAPLDQEPLLSIDLGTAHSAAVTASGDCYTFGSNQHGQLGTNTRRGSRAPCKVQGLEGIKMAMVACGDAFTVAIGAESEVYSWGKGARGRLGRRDEDAGLPRPVQLDETHPYTVTSVSCCHGNTLLAVRSVTDEPVPP

SEQ ID NO: 55736 - protein, 460 aa, Homo sapiens
MEKYERIRVVGRGAFGIVHLCLRKADQKLVIIKQIPVEQMTKEERQAAQNECQVLKLLNHPNVIEYYENFLEDKALMIAMEYAPGGTLAEFIQKRCNSLLEEETILHFFVQILLALHHVHTHLILHRDLKTQNILLDKHRMVVKIGDFGISKILSSKSKAYTVVGTPCYISPELCEGKPYNQKSDIWALGCVLYELASLKRAFEAANLPALVLKIMSGTFAPISDRYSPELRQLVLSLLSLEPAQRPPLSHIMAQPLCIRALLNLHTDVGSVRMRRPVQGQRAVLGGRVWAPSGSTGGLRQRETWGKSSLPACRNVRRVFVLRPPSVLQGREVRGPQQHREQDHQCPLQRYPPGTCEASHPTTTVVSVCLGWWAGHPPAAANAQHRGGPGGSWAHAESRRHALWASHPVGGPTPRCRRRQSPSWGSGAATAPVHLAFPGGPVGCDHQARGLWGLLHCLPD

SEQ ID NO: 55737 - protein, 979 aa, Homo sapiens
MSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRLGLDSEEDYYTPQKVDVPKALIIVAVQCGCDGTFLLTQSGKVLACGLNEFNKLGLNQCMSGIINHEAYHEVPYTTSFTLAKQLSFYKIRTIAPGKTHTAAIDERGRLLTFGCNKCGQLGVGNYKKRLGINLLGGPLGGKQVIRVSCGDEFTIAATDDNHIFAWGNGGNGRLAMTPTERPHGSDICTSWPRPIFGSLHHVPDLSCRGWHTILIVEKVLNSKTIRSNSSGLSIGTVFQSSSPGGGGGGGGGEEEDSQQESETPDPSGGFRGTMEADRGMEGLISPTEAMGNSNGASSSCPGWLRKELENAEFIPMPDSPSPLSAAFSESEKDTLPYEELQGLKVASEAPLEHKPQVEASSPRLNPAVTCAGKGTPLTPPACACSSLQVEVERLQGLVLKCLAEQQKLQQENLQIFTQLQKLNKKLEGGQQVGMHSKGTQTAKEEMEMDPKPDLDSDSWCLLGTDSCRPSL

SEQ ID NO: 55738 - protein, 514 aa, Homo sapiens
MSVLGEYERHCDSINSDFGSESGGCGDSSPGPSASQGPRAGGGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATNPLNLCVKIVQGIRAMEVDSSQYSLELIQMVHSCLDQDPEQRPTADELLDRPLLRKRRREMEEKVTLLNAPTKRPRSSTVTEAPIAVVTSRTSEVYVWGGGKSTPQKLDVIKSGCSARQVCAGNTHFAVVTVEKELYTWVNMQGGTKLHGQLGHGDKASYRQPKHVEKLQGKAIRQVSCGDDFTVCVTDEGQLYAFGSDYYGCMGVDKVAGPEVLEPMQLNFFLSNPVEQVSCGDNHVVVLTRNKEVYSWGCGEYGRGSLVSVHFFTGIQPDFKVVCI

SEQ ID NO: 55739 - protein, 1258 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERGILPGVRPGFPYGAAGHHHFPDADDIRKTLKRLKAVSKQANANRQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 55740 - protein, 1286 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERGILPGVRPGFPYGAAGHHHFPDADDIRKTLKRLKAVSKQANANRQKGQLAVERAKQVEEFLQRKREAMQNKARAEGHMGILQNLAAMYGGRPSSSRGGKPRNKEEEVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 55741 - protein, 1214 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 55742 - protein, 1189 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERAPFLGSGGTIAPSSFSSRGQYEHYHAIFDQMQQQRAEDNEAKWKREIYGRGLPERQKGQLAVERAKQVEEFLQRKREAMQNKARAEGHMVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 55743 - protein, 384 aa, Homo sapiens
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPGMRINLVNRSWCYK

SEQ ID NO: 55744 - protein, 445 aa, Homo sapiens
MPSRAEDYEVLYTIGTGSYGRCQKIRRKSDGKILVWKELDYGSMTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 55745 - protein, 402 aa, Homo sapiens
MTEAEKQMLVSEVNLLRELKHPNIVRYYDRIIDRTNTTLYIVMEYCEGGDLASVITKGTKERQYLDEEFVLRVMTQLTLALKECHRRSDGGHTVLHRDLKPANVFLDGKQNVKLGDFGLARILNHDTSFAKTFVGTPYYMSPEQMNRMSYNEKSDIWSLGCLLYELCALMPPFTAFSQKELAGKIREGKFRRIPYRYSDELNEIITRMLNLKDYHRPSVEEILENPLIADLVADEQRRNLERRGRQLGEPEKSQDSSPVLSELKLKEIQLQERERALKAREERLEQKEQELCVRERLAEDKLARAENLLKNYSLLKERKFLSLASNPELLNLPSSVIKKKVHFSGESKENIMRSENSESQLTSKSKCKDLKKRLHAAQLRAQALSDIEKNYQLKSRQILGMR

SEQ ID NO: 55746 - protein, 506 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKANPSRIRIALGNEASTVQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 55747 - protein, 506 aa, Homo sapiens; identical to SEQ ID NO: 55746

SEQ ID NO: 55748 - protein, 489 aa, Homo sapiens
MDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 55749 - protein, 510 aa, Homo sapiens
MQFGRAHGDCVSGAQLCGCPSMDDYMVLRMIGEGSFGRALLVQHESSNQMFAMKEIRLPKSFSNTQNSRKEAVLLAKMKHPNIVAFKESFEAEGHLYIVMEYCDGGDLMQKIKQQKGKLFPEDMILNWFTQMCLGVNHIHKKRVLHRDIKSKNIFLTQNGKVKLGDFGSARLLSNPMAFACTYVGTPYYVPPEIWENLPYNNKSDIWSLGCILYELCTLKHPFQANSWKNLILKVCQGCISPLPSHYSYELQFLVKQMFKRNPSHRPSATTLLSRGIVARLVQKCLPPEIIMEYGEEVLEEIKNSKHNTPRKKQEEEQDRKGSHTDLESINENLVESALRRVNREEKGNKSVHLRKASSPNLHRRQWEKNVPNTALTALENASILTSSLTAEDDRGGSVIKYSKNTTRKQWLKETPDTLLNILKNADLSLAFQTYTIYRPGSEGFLKGPLSEETEASDSVDGGHDSVILDPERLEPGLDEEDTDFEEEDDNPDWVSELKKRAGWQGLCDR

SEQ ID NO: 55750 - protein, 58 aa, Homo sapiens
MDDYMVLRMIGEGSFGRALLVQHESSNQMFAMKEIRLPKSFSNTQNSRKEAVLLAKMK

SEQ ID NO: 55751 - protein, 841 aa, Homo sapiens
MPLAAYCYLRVVGKGSYGEVTLVKHRRDGKQYVIKKLNLRNASSRERRAAEQEAQLLSQLKHPNIVTYKESWEGGDGLLYIVMGFCEGGDLYRKLKEQKGQLLPENQVVEWFVQIAMALQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 55752 - protein, 752 aa, Homo sapiens
MPLAAYCYLRVVGKGSYGEVTLVKHRRDGKQYLHEKHILHRDLKTQNVFLTRTNIIKVGDLGIARVLENHCDMASTLIGTPYYMSPELFSNKPYNYKSDVWALGCCVYEMATLKHAFNAKDMNSLVYRIIEGKLPPMPRDYSPELAELIRTMLSKRPEERPSVRSILRQPYIKRQISFFLEATKIKTSKNNIKNGDSQSKPFATVVSGEAESNHEVIHPQPLSSEGSQTYIMGEGKCLSQEKPRASGLLKSPASLKAHTCKQDLSNTTELATISSVNIDILPAKGRDSVSDGFVQENQPRYLDASNELGGICSISQVEEEMLQDNTKSSAQPENLIPMWSSDIVTGEKNEPVKPLQPLIKEQKPKDQSLALSPKLECSGTILAHSNLRLLGSSDSPASASRVAGITGVCHHAQDQVAGECIIEKQGRIHPDLQPHNSGSEPSLSRQRRQKRREQTEHRGEKRQVRRDLFAFQESPPRFLPSHPIVGKVDVTSTQKEAENQRRVVTGSVSSSRSSEMSSSKDRPLSARERRRLKQSQEEMSSSGPSVRKASLSVAGPGKPQEEDQPLPARRLSSDCSVTQERKQIHCLSEDELSSSTSSTDKSDGDYGEGKGQTNEINALVQLMTQTLKLDSKESCEDVPVANPVSEFKLHRKYRDTLILHGKVAEEAEEIHFKELPSAIMPGSEKIRRLVEVLRTDVIRGLGVQLLEQVYDLLEEEDEFDREVRLREHMGEKYTTYSVKARQLKFFEENMNF

SEQ ID NO: 55753 - protein, 313 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 55754 - protein, 207 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSL

SEQ ID NO: 55755 - protein, 347 aa, Homo sapiens
MPRREVCWEAAHFRQEEQSLPRPRVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 55756 - protein, 245 aa, Homo sapiens
MAGQPGHMPHGGSSNNLCHTLGPVHPPDPQQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 55757 - protein, 313 aa, Homo sapiens; identical to SEQ ID NO: 55753

SEQ ID NO: 55758 - protein, 347 aa, Homo sapiens; identical to SEQ ID NO: 55755

SEQ ID NO: 55759 - protein, 220 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIH

SEQ ID NO: 55760 - protein, 194 aa, Homo sapiens
MPRREVCWEAAHFRQEEQSLPRPRVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAV

SEQ ID NO: 55761 - protein, 222 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHEN

SEQ ID NO: 55762 - protein, 219 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERI

SEQ ID NO: 55763 - protein, 171 aa, Homo sapiens
MAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHR

SEQ ID NO: 55764 - protein, 201 aa, Homo sapiens [sequence omitted]

SEQ ID NO: 55765 - protein, 338 aa, Homo sapiens
MEATGWDSRCSPGTQVRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 55766 - protein, 331 aa, Homo sapiens
MGRRRPAPFRALVRLACRMAGQPGHMPHGGSSNNLCHTLGPVHPPDPQRHPNTLSFRCSLADFQIEKKIGRGQFSEVYKATCLLDRKTVALKKVQIFEMMDAKARQDCVKEIGLLKQLNHPNIIKYLDSFIEDNELNIVLELADAGDLSQMIKYFKKQKRLIPERTVWKYFVQLCSAVEHMHSRRVMHRDIKPANVFITATGVVKLGDLGLGRFFSSETTAAHSLVGTPYYMSPERIHENGYNFKSDIWSLGCLLYEMAALQSPFYGDKMNLFSLCQKIEQCDYPPLPGEHYSEKLRELVSMCICPDPHQRPDIGYVHQVAKQMHIWMSST

SEQ ID NO: 55767 - protein, 313 aa, Homo sapiens; identical to SEQ ID NO: 55753

SEQ ID NO: 55768 - protein, 313 aa, Homo sapiens; identical to SEQ ID NO: 55753

SEQ ID NO: 55769 - protein, 302 aa, Homo sapiens
MDEQSQGMQGPPVPQFQPQKALRPDMGYNTLANFRIEKKIGRGQFSEVYRAACLLDGVPVALKKVQIFDLMDAKARADCIKEIDLLKQLNHPNVIKYYASFIEDNELNIVLELADAGDLSRMIKHFKKQKRLIPERTVWKYFVQLCSALEHMHSRRVMHRDIKPANVFITATGVVKLGDLGLGRFFSSKTTAAHSLVGTPYYMSPERIHENGYNFKSDIWSLGCLLYEMAALQSPFYGDKMNLYSLCKKIEQCDYPPLPSDHYSEELRQLVNMCINPDPEKRPDVTYVYDVAKRMHACTASS

SEQ ID NO: 55770 - protein, 82 aa, Homo sapiens
MDEQSQGMQGPPVPQFQPQKALRPDMGYNTLANFRIEKKIGRGQFSEVYRAACLLDGVPVALKKVQIFDLMDAKARADCIKE

SEQ ID NO: 55771 - protein, 32 aa, Homo sapiens
MDEQSQGMQGPPVPQFQPQKALRPDMGYNTLA

SEQ ID NO: 55772 - protein, 302 aa, Homo sapiens; identical to SEQ ID NO: 55769

SEQ ID NO: 55773 - protein, 62 aa, Homo sapiens
MDEQSQGMQGPPVPQFQPQKALRPDMGYNTLANFRIEKKIGRGQFSEVYRAACLLDGVPVAL

SEQ ID NO: 55774 - protein, 1242 aa, Homo sapiens
MEKYVRLQKIGEGSFGKAILVKSTEDGRQYVIKEINISRMSSKEREESRREVAVLANMKHPNIVQYRESFEENGSLYIVMDYCEGGDLFKRINAQKGVLFQEDQILDWFVQICLALKHVHDRKILHRDIKSQNIFLTKDGTVQLGDFGIARVLNSTVELARTCIGTPYYLSPEICENKPYNNKSDIWALGCVLYELCTLKHAFEAGSMKNLVLKIISGSFPPVSLHYSYDLRSLVSQLFKRNPRDRPSVNSILEKGFIAKRIEKFLSPQLIAEEFCLKTFSKFGSQPIPAKRPASGQNSISVMPAQKITKPAAKYGIPLAYKKYGDKKLHEKKPLQKHKQAHQTPEKRVNTGEERRKISEEAARKRRLEFIEKEKKQKDQIISLMKAEQMKRQEKERLERINRAREQGWRNVLSAGGSGEVKAPFLGSGGTIAPSSFSSRGQYEHYHAIFDQMQQQRAEDNEAKWKREIYGRGLPERQKGQLAVERAKQVEEFLQRKREAMQNKARAEGHMGILQNLAAMYGGRPSSSRGGKPRNKEEEVYLARLRQIRLQNFNERQQIKAKLRGEKKEANHSEGQEGSEEADMRRKKIESLKAHANARAAVLKEQLERKRKEAYEREKKVWEEHLVAKGVKSSDVSPPLGQHETGGSPSKQQMRSVISVTSALKEVGVDSSLTDTRETSEEMQKTNNAISSKREILRRLNENLKAQEDEKGKQNLSDTFEINVHEDAKEHEKEKSVSSDRKKWEAGGQLVIPLDELTLDTSFSTTERHTVGEVIKLGPNGSPRRAWGKSPTDSVLKILGEAELQLQTELLENTTIRSEISPEGEKYKPLITGEKKVQCISHEINPSAIVDSPVETKSPEFSEASPQMSLKLEGNLEEPDDLETEILQEPSGTNKDESLPCTITDVWISEEKETKETQSADRITIQENEVSEDGVSSTVDQLSDIHIEPGTNDSQHSKCDVDKSVQPEPFFHKVVHSEHLNLVPQVQSVQCSPEESFAFRSHSHLPPKNKNKNSLLIGLSTGLFDANNPKMLRTCSLPDLSKLFRTLMDVPTVGDVRQDNLEIDEIEDENIKEGPSDSEDIVFEETDTDLQELQASMEQLLREQPGEEYSEEEESVLKNSDVEPTANGTDVADEDDNPSSESALNEEWHSDNSDGEIASECECDSVFNHLEELRLHLEQEMGFEKFFEVYEKIKAIHEDEDENIEICSKIVQNILGNEHQHLYAKILHLVMADGAYQEDNDE

SEQ ID NO: 55775 - protein, 599 aa, Homo sapiens
MLKFQEAAKCVSGSTAISTYPKTLIARRYVLQQKLGSGSFGTVYLVSDKKAKRGEELKVLKEISVGELNPNETVQANLEAQLLSKLDHPAIVKFHASFVEQDNFCIITEYCEGRDLDDKIQEYKQAGKIFPENQIIEWFIQLLLGVDYMHERRILHRDLKSKNVFLKNNLLKIGDFGVSRLLMGSCDLATTLTGTPHYMSPEALKHQGYDTKSDIWSLACILYEMCCMNHAFAGSNFLSIVLKIVEGDTPSLPERYPKELNAIMESMLNKNPSLRPSAIEILKIPYLDEQLQNLMCRYSEMTLEDKNLDCQKEAAHIINAMQKRIHLQTLRALSEVQKMTPRERMRLRKLQAADEKARKLKKIVEEKYEENSKRMQELRSRNFQQLSVDVLHEKTHLKGMEEKEEQPEGRLSCSPQDEDEERWQGREEESDEPTLENLPESQPIPSMDLHELESIVEDATSDLGYHEIPEDPLVAEEYYADAFDSYCEESDEEEEEIALERPEKEIRNEGSQPAYRTNQQDSDIEALARCLENVLGCTSLDQPCRSWGQKYLKRSIITSREQGIRMLAKQRSASVWKKWCLKPATVLKWTSSCTLKSSC

SEQ ID NO: 55776 - protein, 152 aa, Homo sapiens
MDSGTEEYELNGGLPPGTPGSPDASPARWGWRHGPINVNHYASKKSAAESMLDIALLMANASQLKAVVEQGPSFAFYVPLVVLISISLVLQIGVGVLLIFLVKYDLNNPAKHAKLDFLNNLATGLVFIIVVVNIFITAFGVQKPLMDMAPQQ

SEQ ID NO: 55777 - protein, 188 aa, Homo sapiens
MAGLSRQLCALSHPKKAAETQTAEPGGAHAVCSRHPVRVKGLEGSEMESARENIDLQPGSSDPRSQPINLNHYATKKSVAESMLDVALFMSNAMRLKAVLEQGPSSHYYTTLVTLISLSLLLQVVIGVLLVVIARLNLNEVEKQWRLNQLNNAATILVFFTVVINVFITAFGAHKTGFLAARASRNPL

SEQ ID NO: 55778 - protein, 90 aa, Homo sapiens
MLDVALFMSNAMRLKAVLEQGPSSHYYTTLVTLISLSLLLQVVIGVLLVVIGEEPSLQSDLLPRHPWLAERPHVSPGPPCIGTGSFATTR

SEQ ID NO: 55779 - protein, 466 aa, Homo sapiens
MPGDSSPGTLPLWDASLSPPLGPDPGGFSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVDGGFGYLKDAMWWAGFLTMAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 55780 - protein, 447 aa, Homo sapiens
MPGDSSPGTLPLWDASLSPPLGPDPGGFSRASHAGDKSRPPAPELGSPGAVRPRVGSCAPGPMELRVSNTSCENGSLLHLYCSSQEVLCQIVNDLSPEVPSNATFHSWQERIRQNYGFYIGLGLAFLSSFLIGSSVILKKKGLLRLVATGATRAVAAGEVANFGAYAFAPATVVTPLGALSVLISAILSSYFLRESLNLLGKLGCVICVAGSTVMVIHAPEEEKVTTIMEMASKMKDTGFIVFAVLLLVSCLILIFVIAPRYGQRNILIYIIICSVIGAFSVAAVKGLGITIKNFFQGLPVVRHPLPYILSLILALSLSTQVNFLNRALDIFNTSLVFPIYYVFFTTVVVTSSIILFKEWYSMSAVDIAGTLSGFVTIILGVFMLHAFKDLDISCASLPHMHKNPPPSPAPEPTVIRLEDKNVLVDNIELASTSSPEEKPKVFIIHS

SEQ ID NO: 55781 - protein, 2804 aa, Homo sapiens
MNGDMPHVPITTLAGIASLTDLLNQLPLPSPLPATTTKSLLFNARIAEEVNCLLACRDDNLVSQLVHSLNQVSTDHIELKDNLGSDDPEGDIPVLLQAVLARSPNVFREKSMQNRYVQSGMMMSQYKLSQNSMHSSPASSNYQQTTISHSPSSRFVPPQTSSGNRFMPQQNSPVPSPYAPQSPAGYMPYSHPSSYTTHPQMQQASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGSLRRSKRNSDSTELAAQMNESVDVMDVIAICCPKYKDRPQIARVVQKTSSGFSVQWMAGSYSGSWTEAKRRDGRKLVPWVDTIKESDIIYKKIALTSANKLTNKVVQTLRSLYAAKDGTSS
